United States Patent 7,745,391 (HUMAN THROMBOSPONDIN POLYPEPTIDE) - sequence listing, part 171

SEQ ID NO: 430995 - DNA, 3084 bp, Homo sapiens
tgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggacaaggatgagggaggttaacagcaggtgctaccaacctgagccttttgcatgtggcattgagcactgttctgtgcactatgtgagtgacagtggggatggagtctatgctgggaggcctctgtcagttatacagatggttggccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccaatttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtaccgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcagatcagccactcttgatctggttttcatgtgggacacaaagctgtgactgcgtgaggggttaaagtgaccaagagcagagggcacacccttacttgatcatctgaagcaaaaaccagaaccagggaaactagaggaggagtcagggagctgctgctcctattcctggagtggttcacctctcccctgcccagtggatggtccagacccaaggaaggagtgaattgaaagctaaggaggggctcagagacagcttcttacacctcatgagccaacctctgctagcttttgactttccttctgcagcttcctcacttctctcaaccatcagagaattaaagagatagggcgttgttctgggtaaggctttgacttaaggtaatgtggctggtttcatctatctagaccactaaagctttctccgtatcagcaat

SEQ ID NO: 430996 - DNA, 1126 bp, Homo sapiens
tgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggacaaggatgagggaggttaacagcaggtgctaccaacctgagccttttgcatgtggcattgagcactgttctgtgcactatgtgagtgacagtggggatggagtctatgctgggaggcctctgtcagttatacagatggttggccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaaggtagagcacgagatggtcactccagctccaagggaggtcaccatattgatgccgaacactagtgcgcacacccgatcggcatagcgcactacagccct

SEQ ID NO: 430997 - DNA, 759 bp, Homo sapiens
cagggtagaaaaaggaagttgtcttccacgaacgcttggaatcgcagtggatttgaatcgaaagttgttcggtctttggggaaggatcaacaaagagctatgtgtttagtctaccatccttaaccagaagtctgggacataattctttataaaaataggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcgatcagccactcttgatctggttttcatgtgggacacaaagctgtgactgcgtgaggggttaaagtgaccaagagcagagggcacacccttacttgatcatctgaagcaaaaaccagaaccagggaaactagaggaggagtcagggagctgctgctcctattcctggagtggttcacctctcccctgcccagtggatggtccagacccaaggaaggagtgaattgaaagctaaggaggggctcagagacagcttcttacacctcatgagccaacctctgctagcttttgactttccttctgcagcttcctcacttctctcaaccatcagagaattaaagagatagggcgttgttctgggtaaggctttgacttaaggtaatgtggctggtttcatctatctagaccactaaagctttctccgtatcagcaat

SEQ ID NO: 430998 - DNA, 1494 bp, Homo sapiens
gggtgggggcaagggtaagggtgagatgcttgggatgagagtgtaaggggtatggagaatctctgggatagcagagaagttaaaaattttgaaaagtctcagtcctgattaagagcaggaaaaataatggaaacagaaataggcgtactttaaatgtgcaaaaactggagactggggagagaaatcgatgcagagggaggctgagaataagggggagatagagtgactaaagtgatgtgagtcccatgtggggagggggatgcaatgtttattgtttaacatttctattaaatgcagccatgagcaattgccaacctgagccaggttgaatcaatgtcttctcacttaatcagctaacaagactgcagactttttttccgtttctgaattggtataaacttggatgcggcgtggtgggtgtcatagataacctctatagggacagaagcctcacaggtcaaaactggctccaaggaaagttttgcagaatgatttcctttccattcttttagaagagctacctttttttttttttttccctgacagggtctggcttgcccaggctggagtgcggtggctagtcacaggtgtaataataggcactgcagtctccaactcctggcctcaagggatcctcacatcttagcctccagaatagctaggagtaggagtagctgggactacaagcatgcacagctgcacttggcttagaagtgctactttatttttatttttgagacagggtcttgtgtcatccagactggagcagtggtgcaattatggctcactgcggcctcgacattccagtctcaagtgatcctctgcctcagcctccggagtagccaggactacaggggtgtgccactagaagtgctactttttaacgaaatggtgactaatgttctggaactttcccattaaccttctgcatttagaaggaattatagatgttgagtgctccagtaaacagtgattctctttatatctgatttttttttttaaacagctaaaatgtaagtatgtatctcagagtcattttgaccattatggaagttgtatctctctgtttcatgtaactaattattaatatatttcatttttagtgtgatgtaatgagagactgtgtgtgtatgttaggtgctcaataaaaactgtatggttagatttaaagaagtggcaaggcaatggaaattctacctgcatttgatctacttccaagtacaccttgaattaagttcttaaacacatcttgaattgctgggaaaagacagaaactaagaagttgacataaagcaagagtcacaaactggcagccacctggccttatcattgttctatttgatttgcaccctggttctctttctttttcccttcctccccaccttcctcccatccattgttgaatctgtggatgcagagcccacggatgtggaggggcaactatatatatgtttttccattatatatataaatgtgtgtgtgtgtatatatgtg

SEQ ID NO: 430999 - DNA, 624 bp, Homo sapiens
tttttttttcagatcatgactggagaattttttcttttagaaaacagttttagagtataaaattctgaagaaatattttgcaaatgttttaaaagaaaataaaatctgggtttggggatattccttctcatttaaattataccaccattaaattaatgctctataggaaataaatcatatccattttgtactactttgagctcagttaaatcttattaaactatcccttgatttacccaacatatgtgctcctaaaaggttccctgcaaatcaaacttgtgtaaatctcatctaaaacgcactagggggagctccctatttgaaagaatcctaaggcatgtgcttttttcacataagtattcttgcaaaagaatgactttctgacttatctgctaaattatttaaattgttttaacacttctttaaaaacatcatcctatgcttattaaatgccactgagacaactttggccaagttatattaattttctttcacacctgcttttctgggatacaatacaaagcccaaagaaaaacatatacttcgtgatactaatagatgtttaaagcatgtaataatcagctttgaagatttttataattttaatttcaaaattaaagctga

SEQ ID NO: 431000 - DNA, 706 bp, Homo sapiens
ttatctctgacactttacacaggcctggcgtatagtaaacatttaatagattttcaaagaagcaataaaaggaataaatgaatgttagcagccaaacctctgttcacctttctctggaacaggagttggcaaactatggtttgagagccaaatccagcccttcatcaaattttgtaaataaagttttattggaactcagtcacacccattcatttatatattgtctatggctactttttcactatagaggcagagtagttgcagggtagttgcaacagagatactatgacccgcaaagtgtttactgtttggcccctttataaacaatttgctaattcttactctagaaccatgtgagctcaaactaaaaaatgggcttctgagcatggaaacagtactaacctatgctgactaacaagctaacctatgcttcttttgttaggtgtttgaaatgatcattaatcctggagataatgtcctcctagatgaacctgcttattcaggaactcttcaaagtgcagaagactgaggtgtaaggattgcttgagcccaggagcatggtgttacagggagccataattgcaccactgcacttcagcccaggcagcaaagtgagaccttgtcacttaaaaaaacaaacaaaaaaggcttaaaatggcaacaattttaccacaataaaactaaaataaaataattactttttctc

SEQ ID NO: 431001 - DNA, 832 bp, Homo sapiens
aaaaaaaaaaaaaaaaaaaaaaaaaaaaagaaaaaaaaaaaagaaaaaaaaaaaaaattcggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431002 - DNA, 607 bp, Homo sapiens
gggatttggctcaagtaaagatgaaggtgaacataatttccctaaatagtctgtatattggtacaagttatggattactttagctgtgtaaatatggtacctcctaggacatttagaaataaggaggaatggggtattcgcattcccagaccggtgattcattatttcaatagtattgtcttttatcctgagtgatgagaaccagtatttagacaactaaacacaaagattgatcctgctacttctaggttccatattttacatagaaatggacttctctttatgaatttttattttgtaattattctacaatgaaggaaaaaacacagcagttaaaagtttttcaccagacaagtgaaacaaatatgctccattcttctatcaagcattcaacattttaatcaagatagaaaacaaattcttatagcctggactctggagactgttttgcttctgcaatcaatgtactgagcacatccatttcattgttttctttttctagggttattgatttctatagtaaccagaaggatgcaatactggcagctgcagacaagtggttaactggtgagtggaacgtatattcgtcctcatgataaacagtagc

SEQ ID NO: 431003 - DNA, 2460 bp, Homo sapiens
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431004 - DNA, 2080 bp, Homo sapiens
ttatctctgacactttacacaggcctggcgtatagtaaacatttaatagattttcaaagaagcaataaaaggaataaatgaatgttagcagccaaacctctgttcacctttctctggaacaggagttggcaaactatggtttgagagccaaatccagcccttcatcaaattttgtaaataaagttttattggaactcagtcacacccattcatttatatattgtctatggctactttttcactatagaggcagagtagttgcagggtagttgcaacagagatactatgacccgcaaagtgtttactgtttggcccctttataaacaatttgctaattcttactctagaaccatgtgagctcaaactaaaaaatgggcttctgagcatggaaacagtactaacctatgctgactaacaagctaacctatgcttcttttgttaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431005 - DNA, 1850 bp, Homo sapiens
cacttttgcctcctgcctcccaccatcagcatgccagcaaatttcctttctcatttgtagctacttttaaagtaaatgttgaagtcagtctttcatgttgactaatttctcatcttcattctcatcatttttctttctgtcggtcctaaggatcagcgttctctctctgaacacccttcagtgctgctggccatcctcattatggtcttgttcaaactagtgtttcttgagtccctcctgtaagtctgttaatcctggatttcaacctctggggcaaagagggcctgtttgaagtttccttaagttcataataatggcatctggagcaaataataagcccttgtgtgtgtttttggcagaaaagccatgaagacaagcagatgctaataaaagaatctgcatctttgtttgttattccatgttaaagggttgaaataaaggtaagagaatatttgtactgttgttatccaaatccatctcctgttctactctctattcaaaataatcgtacagtgactaacagagctttcagaccaacagtattttttatttttcattttaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431006 - DNA, 1547 bp, Homo sapiens
gggatttggctcaagtaaagatgaaggtgaacataatttccctaaatagtctgtatattggtacaagttatggattactttagctgtgtaaatatggtacctcctaggacatttagaaataaggaggaatggggtattcgcattcccagaccggtgattcattatttcaatagtattgtcttttatcctgagtgatgagaaccagtatttagacaactaaacacaaagattgatcctgctacttctaggttccatattttacatagaaatggacttctctttatgaatttttattttgtaattattctacaatgaaggaaaaaacacagcagttaaaagtttttcaccagacaagtgaaacaaatatgctccattcttctatcaagcattcaacattttaatcaagatagaaaacaaattcttatagcctggactctggagactgttttgcttctgcaatcaatgtactgagcacatccatttcattgttttctttttctagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431007 - DNA, 1283 bp, Homo sapiens
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaaggtaagtgattatgtgaacttacttcactattagaagataagttgttttaagttactgcactgtgttgggtattaggctgactgctgagtcagaactaatccacttttaca

SEQ ID NO: 431008 - DNA, 692 bp, Homo sapiens
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgaaacggggtgaccatctctcctttggggtggggcattcctcgcacagcctctaaggagggttccctagcaagccaccgcttggttgcatccatgcgtacccctgtgcacgctcgcggtgagccaggctctgcgtgcagaaatgaaatagacacagcctttgttctcaaagaac

SEQ ID NO: 431009 - DNA, 373 bp, Homo sapiens
ccagcggagcgcgcgggaacgagggtggggccgctcccggctgggcgcagctcgggagccccctgcagtggacccaagtcgccgccagatggttcccgaggattaggatcacgggcacttccggtcccctcggtcagcccctgggctagcctctgggccggcgcctaggccggccaacgcggacgccgggttgcggtgattcccagcggcgaggtcaagagtcattggcctggggctgcaagcgcctcgcgcctgggctaccccgcgccctgcgctctgagggcgatgatccgggacggggaggcgcgcgccgcgggcggccataggccacggcgcggggcgggagggggcgcggcgaggcccgccggcgggg

SEQ ID NO: 431010 - DNA, 805 bp, Homo sapiens
agcccctgggctagcctctgggccggcgcctaggccggccaacgcggacgccgggttgcggtgattcccagcggcgagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgaggtattgtagaagaatgggttaaagtag

SEQ ID NO: 431011 - DNA, 2013 bp, Homo sapiens
agaaaggctcttcctgggaagctgagaaggggcatgcacagcgtgcagatgggtgtacagtggagagggccagctgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431012 - DNA, 2180 bp, Homo sapiens
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaacattttacactgaattattttgagattttaaagaagtaattaagtgcaaaatggtatataatgtgtactttttctacttttaggaaaatttaatgagagcttattgcaaaaattgttataatttggtcattataagtgacttttagtaaaagtaccataaaccttatgttatgccacagaaattcctttaaaataaaattcttaaactaaacataaaaaaaaaaacagacccattaat

SEQ ID NO: 431013 - DNA, 2682 bp, Homo sapiens
  misc_feature (555)..(555): n is a, c, g, or t
  misc_feature (558)..(558): n is a, c, g, or t
  misc_feature (785)..(785): n is a, c, g, or t
  misc_feature (1013)..(1013): n is a, c, g, or t
tgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtagcccacctgggaggaattttccagagatcactgtctgatgaccctgtcttggaattggagccatgcaagttacactgaccacgtttgggttgggatattgaggaggttatggttaaaagcatacgatgggagatcatattgtacttgcgagtgagacccggctggaggaatgttttaattcttcggaaataccaagtggtctctgtaagtaacatagggtggttagccaagcataatgagaccattgaggcatcccagcaagaattgatctgtttagagaagagatgttgctnctncttctttttttttaacattttatttttaattttgctgcctatgacaagctgcttctaacagcctcagggcgaggggcccatgagtgcaaggacaggagaggggtctgcgagttctacttgggtagggcttggggcatcataggagtgcagggatctcctctctgggatccagtttaaccctgatgacatcccccatgcagcaaataactccaggtaaccggcagcanctggtccacatcatagtctgtgagagattgctcatgtcttgcctgttttcctacctcttcattctaaggaaaaggacccacaatctgagtgccctgctctgggacataggtggggaacaggcagggatgggaggtggggaccactttcttctgcacccattaaatatatgcctttttttttgagacagggcctccctctgtcacccagactggagggcagtggtgcantcgtggctcactgctgcctcagtctccagatggctcaagccatcctcccccatcagctgtcaaaatacctggatttacaggtgcatgccaccatgcccagctaattttttctatttttttttttttttgtagagatgggttttcactatttttcccaggctagtctccaacttctgggctcaagcgatccacccgccttggcctcctaagtcctgggattataggtatgagccactgcgcctggcctttttgccttttgaaagtatctgttgttaacaatattcaattgggttgaatcttgctagggaccaaggtgaatttgcataaattagtctatgccaatttgcatactatcagcaaatttgtagtgtacagaattttggaaatagaaggaagctaagaggggtgtcaaatgcagcttcttctttttttacctgaaaagataccaaagtccagctcagggaaggtcacacagctaattcttatcatggggagacagacccagggacatcatggtgcctccgagattagtacggcccctcaaacatccccattttctgtccctagcccattggaaccccttaaagttggtccctcgagctcgggtgatagcacacatgatggaaagtaggcaggcttgccattgaagctccaacctagctctgcaccacatcagctgtgtgacctcgagcaaatcacttaaccactctgagcatggcatttgtaaatgtcaaggtagcaacgccctctttactgccctgttgtgacaaataagatatattccataaatatgatccatgtagtattaaactaccatttactgagtctcccctatggaaagcacttagtaggtgctcaaaaactcctagtcctttcttcccctctttcaatgtgtcactgcatctgggtaatttatacccatttcctgttttcctttgagaagtgcatgtcatgctctgcacaaaagtgactcttaatgatataagggctgctgcagtgcacaactgtctcccaagaaggtaccgcaggggtgtaaaacttctccctgcattgtcaacgctggtctccatggatgtctgctggctttttcaaaaattcttgtagaacagtgcttctcatatggtgattttgtcccccttgccccagggggacctttggccatgtcttgagatgtttttggttgccgtgattgaggaggtgctaccagcgtctgctgggcagagaccagggatgctgctccacatcccacaatgcacaggacaatcttctctacagcaatgaattatccagttcacaatctcaatagcaccaatattgagaaaccctgttgaagatggagactatccacggggcattgatcttggggtctcccccttcctgaatacttgaagtccctcggcagactcttggatacctccagcaatggggagctcaccacctgttttgaagccaggcaggtttgggctcttcttgtagctgtgtgactctggattttcccataggtgggagtggatccaccaccttgagcttcagtttcctccagtgccatgggattagcagcagccctgcctcacagattgcgtgaggatgaaatgagatgatgctcctgagttggctggtgcagtgcacggtacacagagagtgctcaataaatgttccctgctgtgaa

SEQ ID NO: 431014 - DNA, 852 bp, Homo sapiens
tgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtagcccacctgggaggaattttccagagatcactgtctgatgaccctgtcttggaattggagccatgcaagttacactgaccacgtttgggttgggatattgaggaggttatggttaaaagcatacgatgggagatcatattgtacttgcgagtgagacccggctggaggaatgttttaattcttcggaaataccaagtggtctctgtctcacatgagtacttcacaatggggaaactgaactggaactctactgacaacgcagttgggagttcaaacttaataaccttccagagttggtatcaaattcagacgctgacgctccttggagaggttctttgctgcaagaggatggaaaggatcactgtgattttgtttttctcctgctgctctgtctggaagccatgtgaggaggacatctgagcagccctgtggagaggcccccagccaacagccagcatgaacttgctgggcatgtgagtgcaccaccttgaaagtagagcctcaacccctggtcaagccatcaggtaagattgcagccctggcttatatctgaccacaacctcatgagcaacccagatccaggccaccca

SEQ ID NO: 431015 - DNA, 1081 bp, Homo sapiens
tgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtagcccacctgggaggaattttccagagatcactgtctgatgaccctgtcttggaattggagccatgcaagttacactgaccacgtttgggttgggatattgaggaggttatggttaaaagcatacgatgggagatcatattgtacttgcgagtgagacccggctggaggaatgttttaattcttcggaaataccaagtggtctctagatgggttttcactatttttcccaggctagtctccaacttctgggctcaagcgatccacccgccttggcctcctaagtcctgggattatagggggacctttggccatgtcttgagatgtttttggttgccgtgattgaggaggtgctaccagcgtctgctgggcagagaccagggatgctgctccacatcccacaatgcacaggacaatcttctctacagcaatgaattatccagttcacaatctcaatagcaccaatattgagaaaccctgttgaagatggagactatccacggggcattgatcttggggtctcccccttcctgaatacttgaagtccctcggcagactcttggatacctccagcaatggggagctcaccacctgttttgaagccaggcaggtttgggctcttcttgtagctgtgtgactctggattttcccataggtgggagtggatccaccaccttgagcttcagtttcctccagtgccatgggattagcagcagccctgcctcacagattgcgtgaggatgaaatgagatgatgctcctgagttggctggtgcagtgcacggtacacagagagtgctcaataaatgttccctgctgtgaa

SEQ ID NO: 431016 - DNA, 974 bp, Homo sapiens
caggtctgacctgcagattcttccattttaaatcaaggctaaaatatattgaggcttactgaggtctagtggcagctcggagttatcagtgggttgggtagtgcttgctgctctggaactaatggcacaattttattgcatttaggtcaaattgtgcctcaattccaatgtcgtatttttgggtcatgggtctcctctctctttcttttctaaatgtgcccgagtattcctcctggtcctttgggatgctgacagaggagcagatatgcagcatctctgccatgatataagggctgctgcagtgcacaactgtctcccaagaaggtaccgcaggggtgtaaaacttctccctgcattgtcaacgctggtctccatggatgtctgctggctttttcaaaaattcttgtagaacagtgcttctcatatggtgattttgtcccccttgccccagggggacctttggccatgtcttgagatgtttttggttgccgtgattgaggaggtgctaccagcgtctgctgggcagagaccagggatgctgctccacatcccacaatgcacaggacaatcttctctacagcaatgaattatccagttcacaatctcaatagcaccaatattgagaaaccctgttgaagatggagactatccacggggcattgatcttggggtctcccccttcctgaatacttgaagtccctcggcagactcttggatacctccagcaatggggagctcaccacctgttttgaagccaggcaggtttgggctcttcttgtagctgtgtgactctggattttcccataggtgggagtggatccaccaccttgagcttcagtttcctccagtgccatgggattagcagcagccctgcctcacagattgcgtgaggatgaaatgagatgatgctcctgagttggctggtgcagtgcacggtacacagagagtgctcaataaatgttccctgctgtgaa

SEQ ID NO: 431017 - DNA, 2834 bp, Homo sapiens
  misc_feature (555)..(555): n is a, c, g, or t
  misc_feature (558)..(558): n is a, c, g, or t
  misc_feature (785)..(785): n is a, c, g, or t
  misc_feature (1013)..(1013): n is a, c, g, or t
tgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtagcccacctgggaggaattttccagagatcactgtctgatgaccctgtcttggaattggagccatgcaagttacactgaccacgtttgggttgggatattgaggaggttatggttaaaagcatacgatgggagatcatattgtacttgcgagtgagacccggctggaggaatgttttaattcttcggaaataccaagtggtctctgtaagtaacatagggtggttagccaagcataatgagaccattgaggcatcccagcaagaattgatctgtttagagaagagatgttgctnctncttctttttttttaacattttatttttaattttgctgcctatgacaagctgcttctaacagcctcagggcgaggggcccatgagtgcaaggacaggagaggggtctgcgagttctacttgggtagggcttggggcatcataggagtgcagggatctcctctctgggatccagtttaaccctgatgacatcccccatgcagcaaataactccaggtaaccggcagcanctggtccacatcatagtctgtgagagattgctcatgtcttgcctgttttcctacctcttcattctaaggaaaaggacccacaatctgagtgccctgctctgggacataggtggggaacaggcagggatgggaggtggggaccactttcttctgcacccattaaatatatgcctttttttttgagacagggcctccctctgtcacccagactggagggcagtggtgcantcgtggctcactgctgcctcagtctccagatggctcaagccatcctcccccatcagctgtcaaaatacctggatttacaggtgcatgccaccatgcccagctaattttttctatttttttttttttttgtagagatgggttttcactatttttcccaggctagtctccaacttctgggctcaagcgatccacccgccttggcctcctaagtcctgggattataggtatgagccactgcgcctggcctttttgccttttgaaagtatctgttgttaacaatattcaattgggttgaatcttgctagggaccaaggtgaatttgcataaattagtctatgccaatttgcatactatcagcaaatttgtagtgtacagaattttggaaatagaaggaagctaagaggggtgtcaaatgcagcttcttctttttttacctgaaaagataccaaagtccagctcagggaaggtcacacagctaattcttatcatggggagacagacccagggacatcatggtgcctccgagattagtacggcccctcaaacatccccattttctgtccctagcccattggaaccccttaaagttggtccctcgagctcgggtgatagcacacatgatggaaagtaggcaggcttgccattgaagctccaacctagctctgcaccacatcagctgtgtgacctcgagcaaatcacttaaccactctgagcatggcatttgtaaatgtcaaggtagcaacgccctctttactgccctgttgtgacaaataagatatattccataaatatgatccatgtagtattaaactaccatttactgagtctcccctatggaaagcacttagtaggtgctcaaaaactcctagtcctttcttcccctctttcaatgtgtcactgcatctgggtaatttatacccatttcctgttttcctttgagaagtgcatgtcatgctctgcacaaaagtgactcttaatggtggcatttcaagcatcatggcagagtgctgagacgctgatgaagatattttaggctggggtgcatggggagcactctcagggcctctcatgcgcatcctgagcccttcctgtgaaccagactgaccctggcttctgtgccattttcattccagccaagaatgttctgaaatgaagccaatatctgaaggatctaggatgcctgttcccctctcttatgctgtctcgggggatgatttagccaccaagaattttccttatggttgcaagatgattaaaaaaaaccacacactcagatgcttttcggaggttgacatttttcacagcccctcttcctcctccatagatttcctggaggttccatccagctctggctctagctggctccttgactctggacaagtcacttcatctctccaagccttgtctataaagtagggataatactccttcccacttcagagagtcattcggggattaaactgtgacatgtatgtagccaagggtccagcacacactgacaactcaccaaatattagccatcactccaaactaagaaggcaggattccggctgggcacggtggctcacgcctgtaatcccagcactttggaaggctgacgcaggtggatcatgaggtcaagagattgagaccatcctggccaacatggtgaaaccccgtctctactaaaaatacaaaaattagctgggcgtggtggtgcgtgcctgtagtcccagttacaggctgggaggctgaggcaggagaatcacttgaacctgggaggcggaggtttcagtgagccaagattgtgccattgcactccagcctggcgacagagtgaga

SEQ ID NO: 431018 - DNA, 433 bp, Homo sapiens
aaagcagtgggattgcaagtgcaagccaccatgcccagcctccatcttcattatatcagtaccacctgtgtgatcagtgttgtacagaggaggtgatgtatgacttctgaggttatgccgtgaaagacttgcagcttttatctcatcctcttggatcccttttcctcagggaagccatgtgaggaggacatctgagcagccctgtggagaggcccccagccaacagccagcatgaacttgctgggcatgtgagtgcaccaccttgaaagtagagcctcaacccctggtcaagccatcaggtaagattgcagccctggcttatatctgaccacaacctcatgagcaacccagatccaggccacccatgtaagctgcttgtgaattcctcacccacaaaaatcatgtgacataattaatgttcattgtcacttta

SEQ ID NO: 431019 - DNA, 5233 bp, Homo sapiens
  misc_feature (2240)..(2240): n is a, c, g, or t
  misc_feature (2320)..(2320): n is a, c, g, or t
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggccatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggatgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcaganagctaactgctctgtaaactactttccatgagtaaattggtccttggtgggggtgtatcatatttttaacttactgaganatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacgtaattctgagctatggctgcttttgtagcctttccgagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatcgtcctgcttcagcctcccaagcagctaggactacaggtgtgcaccacctttcctggctaatttttttttattttttgtagagatgggggtctcactttgttgcccaggctgaccttgtacttgtggcttcaaatgatcctcctgccttacctcccaaagtgttgagattacaggcatgagccactgtgcctggccaaaaaacattttaaatcccttgtctgggggtcagtcctctaaacatccctcagatttcagatagtactttcaaccctgtcctaacatagcaggtttgcagtaatcttttagaatatagcttgtcaaattagagaatggttttaccccacatgttctcataggagacattattatttagaaccctaaggtagacatgtttaaaatcaaagtcctaagaaacagaactttggaaaaatggaggaaatgtttttaaagtctgtaagtttgcacaatactgtatagtaactaaatgcatgctactccgttgtatcctagttattttagaaacagaggtggcctaatttggtggccaaagtaactggtttactttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttcaactacagtctaaaagtcttgatggtaactatagtgtaattatctttttgtctcactggattttatagttagtggaaaatgcctttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctgcatgtagcttcaccctagatcagacttttgtctcttgggtcccagatggcacaggagcactgcatgcttgttttctagagcccagccagtcatgggtgctagcctagtctccacacaccagcaagtagaacccaagtgtattgtataaatatttcctgagtaccagtaagagaatgcattcttttctcatctaggccaggaatgttgaaaatgctcagccttacatagaaactcctagattttcactaacgcatttcacaaaagtaaataagtatttcatataattcagaggatgtttaaattgtcagcattttaataaatacttgcattata

SEQ ID NO: 431020 - DNA, 2894 bp, Homo sapiens
  misc_feature (2240)..(2240): n is a, c, g, or t
  misc_feature (2320)..(2320): n is a, c, g, or t
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggccatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggatgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcaganagctaactgctctgtaaactactttccatgagtaaattggtccttggtgggggtgtatcatatttttaacttactgaganatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacgtaattctgagctatggctgcttttgtagcctttccgagaagcactaacctgaaataagattagataattgtgagggtgtgttactatattaaaatacacacacaactgatctagacatcaagaggaagaaaaatgatggatgatgccacctgcttcaactgtatataataaacacttatgatgac

SEQ ID NO: 431021 - DNA, 3354 bp, Homo sapiens
  misc_feature (2240)..(2240): n is a, c, g, or t
  misc_feature (2320)..(2320): n is a, c, g, or t
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggccatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggatgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcaganagctaactgctctgtaaactactttccatgagtaaattggtccttggtgggggtgtatcatatttttaacttactgaganatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacgtaattctgagctatggctgcttttgtagcctttccgagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagcca

SEQ ID NO: 431022 - DNA, 5310 bp, Homo sapiens
  misc_feature (2240)..(2240): n is a, c, g, or t
  misc_feature (2320)..(2320): n is a, c, g, or t
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggccatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggatgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcaganagctaactgctctgtaaactactttccatgagtaaattggtccttggtgggggtgtatcatatttttaacttactgaganatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacgtaattctgagctatggctgcttttgtagcctttccgagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatcgtcctgcttcagcctcccaagcagctaggactacaggtgtgcaccacctttcctggctaatttttttttattttttgtagagatgggggtctcactttgttgcccaggctgaccttgtacttgtggcttcaaatgatcctcctgccttacctcccaaagtgttgagattacaggcatgagccactgtgcctggccaaaaaacattttaaatcccttgtctgggggtcagtcctctaaacatccctcagatttcagatagtactttcaaccctgtcctaacatagcaggtttgcagtaatcttttagaatatagcttgtcaaattagagaatggttttaccccacatgttctcataggagacattattatttagaaccctaaggtagacatgtttaaaatcaaagtcctaagaaacagaactttggaaaaatggaggaaatgtttttaaagtctgtaagtttgcacaatactgtatagtaactaaatgcatgctactccgttgtatcctagttattttagaaacagaggtggcctaatttggtggccaaagtaactggtttactttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttcaactacagtctaaaagtcttgatggtaactatagtgtaattatctttttgtctcactggattttatagttagtggaaaatgcctttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctgcatgtagcttcaccctagatcagacttttgtctcttgggtcccagatggcacaggagcactgcatgcttgttttctagagcccagccagtcatgggtgctagcctagtctccacacaccagcaagtagaacccaagtgtattgtataaatatttcctgagtaccagtaagagaatgcattcttttctcatctaggccaggaatgttgaaaatgctcagccttacatagaaactcctagattttcactaacgcatttcacaaaagtaaataagtatttcatataattcagaggatgtttaaattgtcagcattttaataaatacttgcattataattttgtctcttttttaaagaaagtcatacttgaatataatttattaaacgttcaatggagtatatagtctatttga

SEQ ID NO: 431023 - DNA, 4337 bp, Homo sapiens
  misc_feature (2240)..(2240): n is a, c, g, or t
  misc_feature (2320)..(2320): n is a, c, g, or t
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggtggaaagtggttggtttctgataacttcctaaacatcaccaatgtagcttttgatgaccgtgggctctatacctgtttcgtcacctctccaattcgtgcctcctactctgtcaccctacgtgttatcttcacctcgggagacatgagtgtctattacatgattgtttgcctgattgcctttacaatcacactcatcttgaatgtcacacggctgtgcatgatgagcagccatcttcgcaagactgagaaggccatcaatgagttctttagaactgaaggggctgagaaacttcagaaggcctttgagattgcaaaacgtatccccatcattacctcagccaaaactctggagctcgccaaagtcacacaatttaagaccatggagtttgctcgttatattgaagaactggcaagaagtgtccctcttccacctcttattctaaactgtcgagcctttgttgaggagatgtttgaggctgtgcgagtggatgaccctgatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcaganagctaactgctctgtaaactactttccatgagtaaattggtccttggtgggggtgtatcatatttttaacttactgaganatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacgtaattctgagctatggctgcttttgtagcctttccgagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatcgtcctgcttcagcctcccaagcagctaggactacaggtgtgcaccacctttcctggctaatttttttttattttttgtagagatgggggtctcactttgttgcccaggctgaccttgtacttgtggcttcaaatgatcctcctgccttacctcccaaagtgttgagattacaggcatgagccactgtgcctggccaaaaaacattttaaatcccttgtctgggggtcagtcctctaaacatccctcagatttcagatagtactttcaaccctgtcctaacatagcaggtttgcagtaatcttttagaatatagcttgtcaaattagagaatggttttaccccacatgttctcataggagacattattatttagaaccctaaggtagacatgtttaaaatcaaagtcctaagaaacagaactttggaaaaatggaggaaatgtttttaaagtctgtaagtttgcacaatactgtatagtaactaaatgcatgctactccgttgtatcctagttattttagaaacagaggtggcctaatttggtggccaaagtaactggtttactttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttca

SEQ ID NO: 431024 - DNA, 936 bp, Homo sapiens
ggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccagggacacatcagtcaacgaacggaagggccctgctctcaagcagtgcgaaaagcagattataaacaagtcaacaaacgggattatctaaggtggtagttctctactcacatcttttaatcttgaagactagaaaatataactggatctgccacttgtttggaaaatatctctaccaagcaataaattacccgctgtgcttttgttgtagtgtagaagtttttgagttctccaaatctaaacaagattttgtcccattttcccatgaagctacattgttgcttattcactttagtggcaagtattattgtgccagctgcttttgttttggaagatgtggacttcgaccaaatggtttcactggaagcaaatcgtagttcttacaatgcatcctttccctcaagctttgaactctcagcaagttcccactcggatgatgacgtcatcatagccaaagagggaactagcgtttcaattgagtgtcttctcacagccagtcactatgaagatgtccattggcacaattcaaaaggacagcaactggatggcagaagcagaggattgagataagtttggatgatgatgaaaatggacaaaatccagagtgcttactaatttatgtgccactaaaataatccagaaccatagaatcttggggatgaaagagattttgaagattgggcactcaagtaatgcttaacaagcagtccgcta

SEQ ID NO: 431025 - DNA, 470 bp, Homo sapiens
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgagaatcacttgaacccaggaagtggaggttgcagtgagctaagatcgtgccactgcactccagcctggacaacggagtgagactctggggaaaaaaaaaattaaacttcctactttttttctttttgtagagacagagtttcactctgtcgccca

SEQ ID NO: 431026 - DNA, 3431 bp, Homo sapiens
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccgcctcggcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttaataaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaatttta

SEQ ID NO: 431027 - DNA, 3377 bp, Homo sapiens
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccgcctcggcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttaataaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaatttta

SEQ ID NO: 431028 - DNA, 3472 bp, Homo sapiens
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccgcctcggcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttaataaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaattttaacgaacaacaacaccaaaaaaacaaaaacaaacaaaaaact

SEQ ID NO: 431029 - DNA, 3377 bp, Homo sapiens
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgttaaaaaaaaaaaaaaaaaaaaagcgagagagagagatggtgtctcactgtgttgcccaggctggtctcgaactcctggcctcaagtgactttcccgcctcggcttcccaaagtgctggaatcacaggcatgagccacagtgcctggtcttagctgtgtttttaattatgccatgcatcaacataacaccgggccatcttcctatcccttcctatcccatatgtttaatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctagggcttctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttaataaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaatttta

SEQ ID NO: 431030 - DNA, 1514 bp, Homo sapiens
cattcggtaggtcgcgcgggcccagatgggtacttgaatgtttgtgttcaactcagtcatgagtataccataagagcagcatcacttggatcatgtgacttcagagttgcgttggcactttcgtgctaccaatagaagagatacgccccggagagacaaccggtatcgattcttttagctaataatcgcgatgaatggcgctatctcgcatcgtccatgtcacctgcgtaatctggtcatgctaggaagatccatagccggatctcgattatcaagttatggtataaacagtattattaaactgaaggcataagttaaaggaagtatgttactttgagctgatgtaggctcttccacttttatctgtattttacttatttggggactttgtattgctagggcttcagaatactaactttgacacagctcccagagaggtttgcaaacttttggtttccctctcaaatccatggtagtagtttcaaatgagtttgtggataatggatgtttagtccttatcatttgctgtgttttgacagtttttaatttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatatggtacactcctaattatgcattctttggtttccaaatcttaatctaagatactttgttaactgactggtagcctaagaaagagacttttcttcctgtttttctctctccccattttttggggtaagttttgcaaagatcagtgctgcttctcatgactctaaagtaaagctcttttggatagcacagcctaactttacagctagacagaatggccattaagaatatttccaaaatccaagtttatcaaaattattttgtgggaaatcatcaatctattttattaatgttatgtgtttaattttggacttattttgggaaaaactgttcaaattgggtccttttaagcttattttaagcagcctagaaggaagaagctacttagctaatgaaagctgagacactttaataaaagcaggatcttaagagcattgtttttccttaaaaactttatactctcagataatctgcaacaacaaaaattaagaaatccctgacttttgtagaattcccactgtcaaattctcactgacttatgagtgtgagagaagttatcttttgtttgaattctgatagaacagtttaactcctttctaaggatataaaaaattcattggaaagtgtgtatatttcaaagactctcaattatctggactgaaggcactgttctcactatggccagatgaatgggagtattctgtacatgaatcatgctgtattttaaatcaggacatcacttaagtattaatgttgtgtgtacagatttttgttttgggattttttttgcctaaataaatgttataaatttta

SEQ ID NO: 431031 - DNA, 1717 bp, Homo sapiens
  misc_feature (1693)..(1693): n is a, c, g, or t
  misc_feature (1709)..(1709): n is a, c, g, or t
gtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtaatcccagcattctgggaggccgaggcgggcagatcacttgagatcaggagttcgagaccaccctggccaacgtggtgaaaccccgtctctactaaaaatacaaaaactagctgggcatggtggcttttttgcacgcctgtagtcccagctactcgggaggctgaggcacgatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttagggggattaaactctgncccccggtgtaccaancgcgatgg

SEQ ID NO: 431032 - DNA, 2421 bp, Homo sapiens
  misc_feature (1235)..(1235): n is a, c, g, or t
taatagaatttaaaacatttcacaaaagtcaacacataaataatatcaaccaaaataaagtggtagacagaagagaaaatatactaatttattgttcaaagaggaaaataagtctcaaaggttaaggctattatataaatttatttttaaaaagacataaacctacattttcagaagaagaagttccatgtttccttagattatgtatttagcatccattaatcacagggccaaactaacaacaaaagttgtttagctttcccttacaatccagcttttatgggtgtgcaaacatcacattacagtccctccaaccacaaaccccaacatatagtatttcacttcctgcccaatagtgggtgtccccacacctttcaaccactgtagcaacaaagctctggcctaggcttttcacttgcttctttactgcctgactgactttggtgtttcctcatgtggcctggtgtggcatggcacgccctcttgggagatgaaagtaatcttccataggcaattgtttctgtgtcaccattgctgattaaaacaaatcctaagtacaaatgtcagaacagaaacatgcaaagcaagaaaacattacatcatgaaagtttctttttttttcttttttctttttttttttttttgagacagagttttgctctttttgctcaggctggagtacagtggcgcgatcttggttcaccgcaacctccgcctcctgggttcaagcgtttctcctgcctcagcctcccaagtagctgggattataggcatgtgccaccatggctaattttgtatttttagtagagacggggtttctccatgttggtgaggctggtttttaactcccgaactcaggtgattgcctgcctcggtctcccaaaaagtgccgggattacaggcgtgagccattgtgcccagccaaaagtttctttttcaagagatggtggtcttgccatgttgtccagtatggacttgaactactcagctcaagcagtcctcccacctcagcctcctgaatagctgagactacaggcatgcaccactacacctggctgcgagatgaaattttaagagatgggggtcttgttctgtcgcccaggctggagtgcagtgacatgatcaagccgtgatctcctgggctcaagcaatcctcctacctcagcctcctgagtagctggaactacaggaatgcaacaccatgcccagctaattttgatttttagtagagatgnggtcttcctttgttgcccaagctggtctcaaactccagggcttcctgagtagctgagactacaggtgtgagccaccatgcccagcctcctctcttttccaatattgtgttaagtaaattgtattggtggtaatcaacttgatcatttcatttttaggatagagatatcaaggtgagggtataactgaacgagaagaggaataaacaccaccctgtgattgatggatctttatagctctcctttgataaagaagggaaatatcgtacttacattagcatgttatagttgctgttgttatacagaagaatattaaacaatattcatatattgtttatgaatgcattgaattcataaacaatggtatggatattgactagccaaagaggtggataaatgtagatacaatgatacggtgatttggtattcagtgtccattctgctctcctagtgtgccttcctataatgcaggggctggaaggtgagaaaataaccacatttcccagactccctttgcaggtagatttccagatgtgaattgggttccactgatcagacacccatgtgtgagatttggaatgcagaactgaggagagagccatcttcctcttgcttgtgttctggtggcatgtgtggttgaggagacatttaatttccctgcagcagaattcttgcagtcagttgttgaggcaagtggcgtggtggatgcaaccctgattcttcacctttctcattattgtggggtagcagcgcctctggcaagccagacagacctgcagtgtttttctgggagttaattctggagacccagtatggaacccactcctagcccttgtgacaatattgcaagcatccagttccctgttttacagtccttttaaatgtggctagctacagtagtttgtgtttcctgcaactaatcactcatacatctgtatctaaagcactccacctgggtcatgtactatacttaaaattataaggcaatattaattcacaaaactacctactcgttttatttaaccctcagaagaactgaaaacaaaagctataccaggcttgctctagagcgtgggcttgggaatggaaaggcagagtgcacctattgaattccatcatcagtttttctataccatggagttacttaccatgtgtatacataacactgattaaaaattttaaaaaaaag

SEQ ID NO: 431033 - DNA, 2022 bp, Homo sapiens
taatagaatttaaaacatttcacaaaagtcaacacataaataatatcaaccaaaataaagtggtagacagaagagaaaatatactaatttattgttcaaagaggaaaataagtctcaaaggttaaggctattatataaatttatttttaaaaagacataaacctacattttcagaagaagaagttccatgtttccttagattatgtatttagcatccattaatcacagggccaaactaacaacaaaagttgtttagctttcccttacaatccagcttttatgggtgtgcaaacatcacattacagtccctccaaccacaaaccccaacatatagtatttcacttcctgcccaatagtgggtgtccccacacctttcaaccactgtagcaacaaagctctggcctaggcttttcacttgcttctttactgcctgactgactttggtgtttcctcatgtggcctggtgtggcatggcacgccctcttgggagatgaaagtaatcttccataggcaattgtttctgtgtcaccattgctgattaaaacaaatcctaagtacaaatgtcagaacagaaacatgcaaagcaagaaaacattacatcatgaaagtttctttttttttcttttttctttttttttttttttgagacagagttttgctctttttgctcaggctggagtacagtggcgcgatcttggttcaccgcaacctccgcctcctgggttcaagcgtttctcctgcctcagcctcccaagtagctgggattataggcatgtgccaccatggctaattttgtatttttagtagagacggggtttctccatgttggtgaggctggtttttaactcccgaactcaggtgattgcctgcctcggtctcccaaaaagtgccgggattacaggcgtgaccaccatgcccagcctcctctcttttccaatattgtgttaagtaaattgtattggtggtaatcaacttgatcatttcatttttaggatagagatatcaaggtgagggtataactgaacgagaagaggaataaacaccaccctgtgattgatggatctttatagctctcctttgataaagaagggaaatatcgtacttacattagcatgttatagttgctgttgttatacagaagaatattaaacaatattcatatattgtttatgaatgcattgaattcataaacaatggtatggatattgactagccaaagaggtggataaatgtagatacaatgatacggtgatttggtattcagtgtccattctgctctcctagtgtgccttcctataatgcaggggctggaaggtgagaaaataaccacatttcccagactccctttgcaggtagatttccagatgtgaattgggttccactgatcagacacccatgtgtgagatttggaatgcagaactgaggagagagccatcttcctcttgcttgtgttctggtggcatgtgtggttgaggagacatttaatttccctgcagcagaattcttgcagtcagttgttgaggcaagtggcgtggtggatgcaaccctgattcttcacctttctcattattgtggggtagcagcgcctctggcaagccagacagacctgcagtgtttttctgggagttaattctggagacccagtatggaacccactcctagcccttgtgacaatattgcaagcatccagttccctgttttacagtccttttaaatgtggctagctacagtagtttgtgtttcctgcaactaatcactcatacatctgtatctaaagcactccacctgggtcatgtactatacttaaaattataaggcaatattaattcacaaaactacctactcgttttatttaaccctcagaagaactgaaaacaaaagctataccaggcttgctctagagcgtgggcttgggaatggaaaggcagagtgcacctattgaattccatcatcagtttttctataccatggagttacttaccatgtgtatacataacactgattaaaaattttaaaaaaaag

SEQ ID NO: 431034 - DNA, 1773 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttcc

SEQ ID NO: 431035 - DNA, 4193 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431036 - DNA, 4261 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaaaaaatccgtcagataatcttttctcataagttaaactgaagcaaaacatctacaatttcagctaaaac

SEQ ID NO: 431037 - DNA, 1984 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttcccataaaaaaaaacacacacacgacacaacacactccacatcactgacacacaacagcaccccgcaccaacccaccacccacacgacacataaacacacgcgcggggcgccctacaatatcccccacgcgcaactcacgcgacccgcctcgttagacacccccacacacgcctcaacacccggccccggccccaaccgccacgagagcctct

SEQ ID NO: 431038 - DNA, 3533 bp, Homo sapiens
tacagggtatctgtcagatgctttcaggcaggtactgaagtttggagagctgagtcataagtaatattgattatttaaggccaattataaatctgtcttaaaaaaagacttaccgtaaaccatttctgtgtcaacctcccttcaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431039 - DNA, 1698 bp, Homo sapiens
  misc_feature (1589)..(1589): n is a, c, g, or t
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaatataaaatgctgcagctgctttggaaaagtctggcagttcctcaaaaaattaaacagttacctcatgacccggcaattctactcgagaattgnaaagatgttaatataaaatgtatacaaaaatgttcacagcagcattattcttataaagccacggagtggagacaacccaaatgtccatgaacagatggacaaaaaaaaa

SEQ ID NO: 431040 - DNA, 4106 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431041 - DNA, 4405 bp, Homo sapiens
  misc_feature (1470)..(1470): n is a, c, g, or t
  misc_feature (1474)..(1474): n is a, c, g, or t
  misc_feature (1479)..(1479): n is a, c, g, or t
  misc_feature (1481)..(1481): n is a, c, g, or t
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaanaaanccacnanacaaactttaaaaaatatgaacccaaactcccgcctcacttcgtctctacagaatgttcacagcaaaacacgtttggtctgtttttagattcttgaagaattcaatagtctttcaagatgtttaactgtgtttaaagctgggaacctgttgggagttcacaagtgctgcatattactggggtagcaaaagaaccatggcaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431042 - DNA, 4058 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431043 - DNA, 3481 bp, Homo sapiens
ctcggagctctagagttttctattactctatgtagttgagacaggatttgactaagtctagttaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431044 - DNA, 3366 bp, Homo sapiens
gtcatcattcaaaataaaacaaaataaaaaagtattaaggcgaagattaaaaaaatttgcattacataatttacacgaaagcaatgctatcacctcccagcatgcattccgcgtggcatgcggggggggaaacacacacagcatgaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431045 - DNA, 3776 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagtatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431046 - DNA, 4136 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgttggggacctggccatggcccctcagcaaaaacctattcacagcgggtggggaaacacacacagctccctgctgactccccttatggatctcagtttgctcctttttatggacctttaatggagagagagtaaccctccacagaatgtctgaattcttgcattctttacccttccatcactatattgattctttttttaaaaaacatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431047 - DNA, 3469 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431048 - DNA, 2974 bp, Homo sapiens
aaaacacgtttggtctgtttttagattcttgaagaattcaatagtctttcaagatgtttaatgtgtttaaagctgggaacctgttgggagttcacaagtgctgcatatactgggtagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431049 - DNA, 1049 bp, Homo sapiens
ggccccctccgggggggggaggcccgggaccgggacccgtagcgaattctcctaactccctcgacctctcctctcgcccggcccgagtgtgaggagaagggcccggcccggcctgcgtcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttcc

SEQ ID NO: 431050 - DNA, 589 bp, Homo sapiens
tgcggccgctccaacatcagaatcatatacttctccactcatttctcaaaatacacagaactgaagagcatctattgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 431051 - DNA, 2200 bp, Homo sapiens
aaaaaaaaaaaaaaaaaaaaaaaaaaaaaacaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgtccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctgagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcattttttttaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaataaaaaaaat

SEQ ID NO: 431052 - DNA, 2239 bp, Homo sapiens
tcatgtacattgcatttgttttaaatgttgagtgtacattggatatatggtatgaatgtgttttgtatattcatggctgttgtctgcatgcaactcgtatgcaccttccctctgtctttcatttatgctgcatgtgccctgcatgtgggttattgtatatgtgtatcatgggtgcggcattcctgttgaatgtctattgtgtatcgcacatatcttgggtactacatgaatattgtatgcacttggtattgttccattcattctgcaacattgttttctacctgtacattacatgcatatttcatgtgtttcttgtgcatgctatatgcttcatgtggcatccatgcccatgcaccacatatgttacgtgtaaactgtgtggtgtgtgtgtggcgtgtatgttttggtgttctgccttcagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaaaaaaaaaa

SEQ ID NO: 431053 - DNA, 3043 bp, Homo sapiens
gagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgcccagagccactgccttcacccaggtgctaccacctgacagtgcctgaaacaaggccccggggacctggtaggcagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcgacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaaaaaaaaaa

SEQ ID NO: 431054 - DNA, 504 bp, Homo sapiens
catgtgtttcttgtgcatgctatatgcttcatgtggcatccatgcccatgcaccacatatgttacgtgtaaactgtgtggtgtgtgtgtggcgtgtatgttttggtgttctgccttcagacagttctgcacaggcctcgcgcgtgcaagtggccatccagaccctggatgagaatgacaatgctccccagctggctgagccctacgatacttttgtgtgtgactctgcagctcctggccaggtgagcaactgaggcagaggggttgggacgtccaggcctccagcagcccactccatacaaggcctctctcttcttcctcccagctgattcaggtcatccgggccctggacagagatgaagttggcaacagtagccatgtctcctttcaaggtcctctgggccctgatgccaactttactgtccaggacaaccgaggtaggtggcctcctacagccatgtccatacctgcctctgtccccttctcctcctcctccacccctagc

SEQ ID NO: 431055 - DNA, 564 bp, Homo sapiens
tgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccaggtcagtgcccctagactgtggggcagggcggtggatgaaggctcccactccccactgcctctaacgtggctcccctgtccttacagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaaaaaaaaaa

SEQ ID NO: 431056 - DNA, 1160 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtgaagctcggagccagattcatgagtcagcaaggaactgagagcctttacagtctggcatcaagctgcc

SEQ ID NO: 431057 - DNA, 1079 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccggtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431058 - DNA, 3709 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431059 - DNA, 3977 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcatgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431060 - DNA, 3655 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431061 - DNA, 3655 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgctttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431062 - DNA, 3312 bp, Homo sapiens
ctgttttcaagagattcctcttgcagaagaggccaagtataaacatggaagagtaactgcctaagtaggaaagtgttccataataatgtgcaaacaaggagttctgagttaatctctggaactcgacctggaccttgatcttgactttgagcgagatctagaacgggatcttgaagtagctctttttggtggaggggacacagaacgggcctttgagggtggaacaggtagcggcgaattgaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431063 - DNA, 3139 bp, Homo sapiens
tgttgtatttgatgtttcagactacctatctactgtatagtcaatgagtgctatagtgacaatactggaatagtacagaaataagtggcataaatatcaagctcattgaccataaggctatcaccataccctaggccagcttactctgtgcagcagctccggtgctttcgcatcttacatgagtgacaagaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431064 - DNA, 2848 bp, Homo sapiens
tcctgccttccttccgggccgactttaaagaatccctcactctcacacacacctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431065 - DNA, 3598 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431066 - DNA, 3880 bp, Homo sapiens
  misc_feature (3602)..(3603): n is a, c, g, or t
  misc_feature (3605)..(3605): n is a, c, g, or t
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaaaannanaaaaaaaaaaaaaaaaaatttttgggcggcggggccctagaagaaggtcttctagaaccacattgtgtttgggcaacgcggccccacagagggataaggatgaactgcgcactaggtggtacccagaggaaaaccggggccaagacataggcgcgggtatttccccccataataaagcgccgggggcacaccgaggggtgtgggacagaccaaaggaatcaggagggcatacggggcttaccacacgaggttcaaggacccgcatttaaatacgc

SEQ ID NO: 431067 - DNA, 3041 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcaccccctcataatcccatttatagtcatcttgtctgtggcaatgtagcctagagctgcctcttgtgagtagtggatc

SEQ ID NO: 431068 - DNA, 992 bp, Homo sapiens
cgggctgcaggaattcggcacgagatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431069 - DNA, 998 bp, Homo sapiens
  misc_feature (5)..(5): n is a, c, g, or t
gttgnttgccgcctgcaggtccctctagaggatccccccaatcaacatccaaccttccagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431070 - DNA, 2024 bp, Homo sapiens
  misc_feature (1960)..(1960): n is a, c, g, or t
  misc_feature (1965)..(1965): n is a, c, g, or t
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactattaaggngcccnatactgggacctggttagagtccacttccggagtcccgctagtgtgaggggtcgtggct

SEQ ID NO: 431071 - DNA, 1012 bp, Homo sapiens
atacgaggaatccaaggaacaagggacgtcgaagcacctcttcaaggagaactacgaaccactgctcaaggaaataaaagaggacacaaacaaatggaagaacattccatgctcatgggtaggaagaatcaatatcgtgaaaatggccatactgcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431072 - DNA, 1391 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcgcgtctgcgtgggggcagggagtgtgtgggactctctgtaccttctgctccattttgccatgaagctaagactgcactagaaaataaagtctatttaaaacaaaacagaaaaggtgatgttgagggagccctagaggaagacgctggccagcagtaggtg

SEQ ID NO: 431073 - DNA, 764 bp, Homo sapiens
tggggagggctagagaaaaatcctagaagctagcaagaccgcactacaccgaaacgtcgcgggcaacggactcgccagtcaccatctagcccagggacgacgcgggacggacgtgccgctgcgcgctgacatcacgctccaggccccgccccaccggccgcccatatagcgaaagcctggcgcgcgcgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtgagtcgggcctgggcgcccgcgcccagcgtcccaggcctggtggcggcgggaactctccaaggaaagaagcggccaaggccgcggcgccgcgtggcagggcctcaaagatggcgacggcgcggcgtcgcgggggcgcgcggtggggtacgggcgcgcgcacgtgcgcgtcctggctaacgactcccccgcggttgtccggccctcgcaccgcccctaggtacggcttcgtggagttcgaggactcccgcgacgccgacgacgccgtttacgagctgaacggcaaggagctctgcggcgagcgcgtgatcgtagagcacgcccg

SEQ ID NO: 431074 - DNA, 751 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtgagtcccacccccgcgcgctccgcgcccttggggaccctgggggcgggggtgggtggggtggggcctcccagcccgggcaggcgcgagggccgggggtcgtttgacttgggtgtccccgagccccgctgccttcacgtctgcccggggcagccatgggacgccggagcgcggggattgggtttgggtgtttggttttgtttatttgccaagttgggaggtgggtggcttcttctggccccttgtcagcactgtcacgggttcttcccacagaggaagtaaggggtggctgtatttgttgtattctccttacttacctatcagtgcattagttagaggttcgggggca

SEQ ID NO: 431075 - DNA, 3693 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431076 - DNA, 4157 bp, Homo sapiens
ggtcttaaagctatggaacttgatgggggccaaagaatgtactatttttaagtaatgtggtattgtaccacaaagtagatctaaataagctttatgctgtatttgaactaattggggcatgttattgggaggaggttggggggatttttggttatgttaaatgtttgatgtttaaattgttgcatgttgaattcaaactttttaacaagtccttgatgtttcaatttgaaagtgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtaagtacttagtgtaaaactagtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431077 - DNA, 4294 bp, Homo sapiens
ggtcttaaagctatggaacttgatgggggccaaagaatgtactatttttaagtaatgtggtattgtaccacaaagtagatctaaataagctttatgctgtatttgaactaattggggcatgttattgggaggaggttggggggatttttggttatgttaaatgtttgatgtttaaattgttgcatgttgaattcaaactttttaacaagtccttgatgtttcaatttgaaagtgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtaagtacttagtgtaaaactagtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggtatgttttgtaattcaagatagaaatgatatgactaatgctttaaagtaaactccttttatattcttatttctgggaatttattatggtatatagatgttttaagatttccgagtctgaccaatcttgtctttcaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431078 - DNA, 3639 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaatttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431079 - DNA, 3652 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttcttagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaa

SEQ ID NO: 431080 - DNA, 3991 bp, Homo sapiens
  misc_feature (3713)..(3714): n is a, c, g, or t
  misc_feature (3716)..(3716): n is a, c, g, or t
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaaaannanaaaaaaaaaaaaaaaaaatttttgggcggcggggccctagaagaaggtcttctagaaccacattgtgtttgggcaacgcggccccacagagggataaggatgaactgcgcactaggtggtacccagaggaaaaccggggccaagacataggcgcgggtatttccccccataataaagcgccgggggcacaccgaggggtgtgggacagaccaaaggaatcaggagggcatacggggcttaccacacgaggttcaaggacccgcatttaaatacgc

SEQ ID NO: 431081 - DNA, 3050 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcatgaactcctcactaattttttcgacaggaaaattggatatctccgagttgtagttgcagtccttcccctcccttatatgtgagct

SEQ ID NO: 431082 - DNA, 3096 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccctacattgtgacacctcctagaaaggtattaaagctgagccaattaatctatattttgatttcagactaagattaataaatgcttttaaataaagtaacttttaaggtatctgaacaaagggatgtaaggttaattcacttctcatactgcaatttcaactcatcaggcttatggatgtatggactaattgctaacctagtaactcctacaaatgtgcagta

SEQ ID NO: 431083 - DNA, 1545 bp, Homo sapiens
cgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttgttaagtctttgtttctttttgtctggtaattggtgtatatggtattttatacacacgcacaaaagttcgttcgtgacaaatcgg

SEQ ID NO: 431084 - DNA, 570 bp, Homo sapiens
aatttcgtagtaaagaaaaacattattctttggcttatctatttttgccagatggcacggatgtatttaagttggattgggattaagacttcattgtttttctcctaataggtctcgatctagaagacggtcacgaagtaggagtcgcaggagcagccgcagtagatctcgaagtatctcaaaaagtcgctcccggtaaataacgttgtgttgagtcactgtgaatattaccgtacttgtttatggagtatgtgtacattctcactaagtattgagaaaatcggtctttccttgtccagttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtg

SEQ ID NO: 431085 - DNA, 747 bp, Homo sapiens
aaattttgtctaacctggcttctgaaatttctcaaactaaatattcatgctgttttgtgtttttcttaatgactgaggctagtgatattactcagaaaagtaacagtaacttgggtcttctgagcgtcaggatgttcaccatttaacttgtttctcgttagtgtctagtacgtcggctttcggtagtgtaggtgtgtgttctgtgtcctttcccgtgtgtgcctgcactagtggcagcctctgcttccaggtcagtttagagtagactggctctggtattgctagcaagtagttgctgttacccagtgtagccatgaagcccagctccttggatcttgacatatatgttccaggcaaagtacgtaatccagacgtttctaactctttctagatgattgcaattgttctccatgttgtctgttaggcgttatgttaattctcgatctaacagtgtgcctgtaacatatatggtagtgaagagacatcacatgcagagaccgttttccttttatcaactacaggtccgctatcgacgagagcacctttctgctaggcagtcaccctacttcccgttgttggaggatttgatgagagacggcagtgatggtgctgctctcttagctgtgattcactattattgcccagagcagatgaaactggatggtgagtggagaatgcttccctgaaacagatccgaaaaggcttaaaggaaaattatagtgtacattgatccacatatatattaaa

SEQ ID NO: 431086 - DNA, 742 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtaaagggtaaatttaatttttctggaatgcactaagttaatgttggtcccaattttaaagaattctgttagttcccacctgtgccgaat

SEQ ID NO: 431087 - DNA, 7627 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431088 - DNA, 7660 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagtctccctccaagtggtattggaagttagtgcctgtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431089 - DNA, 7202 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431090 - DNA, 7584 bp, Homo sapiens
aaattttgtctaacctggcttctgaaatttctcaaactaaatattcatgctgttttgtgtttttcttaatgactgaggctagtgatattactcagaaaagtaacagtaacttgggtcttctgagcgtcaggatgttcaccatttaacttgtttctcgttagtgtctagtacgtcggctttcggtagtgtaggtgtgtgttctgtgtcctttcccgtgtgtgcctgcactagtggcagcctctgcttccaggtcagtttagagtagactggctctggtattgctagcaagtagttgctgttacccagtgtagccatgaagcccagctccttggatcttgacatatatgttccaggcaaagtacgtaatccagacgtttctaactctttctagatgattgcaattgttctccatgttgtctgttaggcgttatgttaattctcgatctaacagtgtgcctgtaacatatatggtagtgaagagacatcacatgcagagaccgttttccttttatcaactacaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaaggtaataacgaattatttggcatgcagttttaaaaccatgtgtgaataaactgcttatcatactttggttttttgtttttgtcttttagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431091 - DNA, 6523 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgcttta

SEQ ID NO: 431092 - DNA, 4805 bp, Homo sapiens
aaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431093 - DNA, 3713 bp, Homo sapiens
cgagcagtgtctgggcgtgtgtttctctcaggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431094 - DNA, 3603 bp, Homo sapiens
aagtcggtaccctatcaggctttggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431095 - DNA, 3449 bp, Homo sapiens
tgcagggcgaggtgaggggaacaggtacaggggacaggtacttgtctgtcggaatccgttcatgaaccgtcgtctgtttctgtctctggcagctgataacttgagccggactcagtcaggctccagcctgtccttggcctctgcggcgacgacagaacccgagagcgttcattccgggggcacaccctctcagcggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcaaaaaaaaaaa

SEQ ID NO: 431096 - DNA, 4325 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgaatagttgcaatcatgtcatcaggaataccagtgcccttcacacgggctccccagctggttaaacgtg

SEQ ID NO: 431097 - DNA, 1395 bp, Homo sapiens
cggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaaggtaataacgaattatttggcatgcagttttaaaaccatgtgtgaataaactgcttatcatactttggttttttgtttttgtcttttagccgaatgttatggtttttattgcggagcttttttggtggttcgagaatgtcaagccagattttgttcagcccagggatgttcaggagctgaaagacggtgagtgacagatattccccaggttggcaatggtttccttgagagcctagagtatcagaaagcactctccagtggttccatgtttctcgcacagcagagttcttggaagagcctgtggagtcagaatcccagggacgggcgtgagagtttggggaaaggctttctaagtgattttgatgaactattcggttacgaatcacagctctaaaaattgcacaactctaaaagttccaggatggctgttctcacctccagaatgaacaaactgaaaaaaaa

SEQ ID NO: 431098 - DNA, 483 bp, Homo sapiens
agggctggaggaagatggaggccccgccggacggcgccgccgacctcgtgcccctggaccgctacgacgcggcgcgcgccaagatcgccgccaacctgcagtggatctgcgccaaggcctacggccgaggtgggccgggtgaggggcgcggggcgggggccaggggcgcgggccggggccgggggacgcggccggggtccggccgggtcggggtccgcgcgccgcgcctttgtgccgcgtccgcacagggtcggggctgggccggccgcctccgaggtcctggcggcgcccgggcaacgcggagcgtggggacgcggtcacctggcgagtgggcgtccctgcggcggagggcggcgtgggtcggggcttccgctcctatttcgggagtgcccccagcctcccgttggcggcggcggcggcgggaaggagctgcccggttctgggcgcagggagggaccatggggacgcggggccgccgtctga

SEQ ID NO: 431099 - DNA, 2245 bp, Homo sapiens
gccgcgcgcggtcagctagagtttggctactggacccaggaagggagggagcgggaggagctggtggctgtcgggtcggggtctgggcgccaccgagcgcccgccccacctctggagtgcgcagaaggcggtgcgtcccgggccccggcagcccagcccaggcgctctggccaagtttgcgcgcggtctccgctgactctcgggttacctgagccggcaaccacgtcagcgccacatcatctgggctttttatattgcaaggaaacaggaaaagaaggaagaaaaacatcgcccgagagagccaatcgcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgat

SEQ ID NO: 431100 - DNA, 2415 bp, Homo sapiens
gccgcgcgcggtcagctagagtttggctactggacccaggaagggagggagcgggaggagctggtggctgtcgggtcggggtctgggcgccaccgagcgcccgccccacctctggagtgcgcagaaggcggtgcgtcccgggccccggcagcccagcccaggcgctctggccaagtttgcgcgcggtctccgctgactctcgggttacctgagccggcaaccacgtcagcgccacatcatctgggctttttatattgcaaggaaacaggaaaagaaggaagaaaaacatcgcccgagagagccaatcgcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagatt

SEQ ID NO: 431101 - DNA, 1725 bp, Homo sapiens
acttgagtcagtagaaaatggggagcctctgtgggctcctggtcctgcaccgtgataaatagcctgtcctgcaacctggcttaaaacagggaaagccggagttaggcaacagagtgcctagctttctcagtcattcaaacacaagcacggaagaagagattgcactgaccagaggaccgccagggtgtgatgctccgtagtcgcagggatgaaggaaaaccatgggcggagcttgtcatggacagctcctaggtggacataaatggaaactcattggttctggggcacggcgggaagagggagacggccctggacggccgcaccaagaatttcacaacccaaacccgactagaaagcctgggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431102 - DNA, 1723 bp, Homo sapiens
gtgggtagcctcggatgagtttttcctgatggtctaagatgggtgtgggccttagcttcttagtacacagaacttgtgtttgagcctgatagtgaattcaagaccagagaccctgatgtgttggaattgctggttggattttacaaagaatggtggactttcaaacttatggtgaccactgttgaattttactgggacatgacaattatactagagcccctaaagtggcagacctgaagtctcgctgttctctttggtttgaggggaataagggcagatgataggcatatattgtttaaaaacgtgtttgccactttgtctcttcctcttcgcctcagtgaccttgttctccttgcagggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431103 - DNA, 1570 bp, Homo sapiens
tgactgagaagagctaaaccccagtagagccaagttgggaggtggtgaaaaaaatccaggtgaatggggctaagaccccatacccaggaagcgagctggcatcagaagcagaagactgaggtcatttttatggatgggagatgtgctggtgggtttttagaagagctcatgtcagttggcatccatttcttcagtaaggtgagaaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431104 - DNA, 1322 bp, Homo sapiens
acggccagcgcattgaccagaagcggcccacactacacgcgcgcgaacacacacacacacgttatggccacaccgtgcccttgtcagatggaggtaaggccttctgcatcatctactccgtcattggcattcccttcaccctcctgttcctgacggctgtggtccagcgcatcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431105 - DNA, 504 bp, Homo sapiens
ataaaacaaaaacttttctaaaacatcactggctttttgtgagccactgattataaagcagaggtggcaaaccctccttgcataaaatatcacacttgggtaagtgcagtatgttatgtgtctttaataatgccacatcagccccaagtattttttttttctcaaaaattgcagcctgtgattctaactaatccaagttcataggaggttaaatcattcttcattgtctttcactctttaataatgggtagttcctctttgaaccatgaacttaaaaacacttctaaaaattaagaaactggcaatgagtttattccttaacaaacactgtgttggcatgaggtggggaggtaaatcactcgctacttgatttatccatgttgagatcacactaagacagtgtcctgtttctcacacaggttacctgctacttggccttattgccatgttggtagttctggaaaccttctgtgaactccatgagctgaaaaaattcagaaaaat

SEQ ID NO: 431106 - DNA, 363 bp, Homo sapiens
ccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaa

SEQ ID NO: 431107 - DNA, 2206 bp, Homo sapiens
gccgcgcgcggtcagctagagtttggctactggacccaggaagggagggagcgggaggagctggtggctgtcgggtcggggtctgggcgccaccgagcgcccgccccacctctggagtgcgcagaaggcggtgcgtcccgggccccggcagcccagcccaggcgctctggccaagtttgcgcgcggtctccgctgactctcgggttacctgagccggcaaccacgtcagcgccacatcatctgggctttttatattgcaaggaaacaggaaaagaaggaagaaaaacatcgcccgagagagccaatcgcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431108 - DNA, 1644 bp, Homo sapiens
gccgcgcgcggtcagctagagtttggctactggacccaggaagggagggagcgggaggagctggtggctgtcgggtcggggtctgggcgccaccgagcgcccgccccacctctggagtgcgcagaaggcggtgcgtcccgggccccggcagcccagcccaggcgctctggccaagtttgcgcgcggtctccgctgactctcgggttacctgagccggcaaccacgtcagcgccacatcatctgggctttttatattgcaaggaaacaggaaaagaaggaagaaaaacatcgcccgagagagccaatcgcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagtgacataattttcgcttttgcattctgataaaaatgaacatacttaagcctcttcct

SEQ ID NO: 431109 - DNA, 2353 bp, Homo sapiens
gccgcgcgcggtcagctagagtttggctactggacccaggaagggagggagcgggaggagctggtggctgtcgggtcggggtctgggcgccaccgagcgcccgccccacctctggagtgcgcagaaggcggtgcgtcccgggccccggcagcccagcccaggcgctctggccaagtttgcgcgcggtctccgctgactctcgggttacctgagccggcaaccacgtcagcgccacatcatctgggctttttatattgcaaggaaacaggaaaagaaggaagaaaaacatcgcccgagagagccaatcgcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggtgaatggggctaagaccccatacccaggaagcgagctggcatcagaagcagaagactgaggtcatttttatggatgggagatgtgctggtgggtttttagaagagctcatgtcagttggcatccatttcttcagtaaggtgagaaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431110 - DNA, 1473 bp, Homo sapiens
gtcctgagggttttatctcctgatttggttagaagattgttgaatctggctgtgagagcctttcaagtgcctaaaggagagagcttgaacttccctgagagtacaccaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 431111 - DNA, 3045 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctaccggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtggctcacgtctgtaatcctagcactttgggaggcccaggcaggcggatcatctgaggtcaggagttcgagaccagcctggctaacatggtgaaccctgtctctactaataatacaaaaaattagccgggcgtgatggtgggcgcctgtaatcccagctactcgggaggctgaggcagaattgcttcaacccaggaggtggaggttgcagtgagctg

SEQ ID NO: 431112 - DNA, 2856 bp, Homo sapiens
agcagtgaatcgagctctgggccctatctaggaccgtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctaccggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtggctcacgtctgtaatcctagcactttgggaggcccaggcaggcggatcatctgaggtcaggagttcgagaccagcctggctaacatggtgaaccctgtctctactaataatacaaaaaattagccgggcgtgatggtgggcgcctgtaatcccagctactcgggaggctgaggcagaattgcttcaacccaggaggtggaggttgcagtgagctg

SEQ ID NO: 431113 - DNA, 2922 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcactctcacatcgtcggtcttcaaacttcctgggacatgtgggttgttactgagtctctcccatgccctgtcttacttcctgccctaatcggagacgctgagtaagggctgggctctaagagggcgatttaggtgatctctggttcgtgaagcagaggcagcagtggaggataggtccctgagctgcccttgactcatgtag

SEQ ID NO: 431114 - DNA, 3068 bp, Homo sapiens
ttttttttgagacagagtctcgctctgtcacccaggctggagtgcagtggcgtgatctcggctcactgcaacctccgcctcccgggttcgagcaattctcctgcctcagcctcctgagtatcggattacaggcgtgagccaccgagcccagccccttcctccatttctttactcccaccctgctcctggtttctagggaagggaaaccaggaagttcacttggaagacgtttcctaggttttctcatcagatgaagccatgggaacgcccaggaagtccatactctcaaacccctttctgcccactcaccttcaggtccacagcactttccagcgtcatctgaaatagcaaaggtgatgtgcagcatcccagtgatgtgttcctgtgttatgagaaggagtctggggttctggatgcctcaggaacagaatatggaccttaaagaccaggctgagagcctggcctggcacgcagcctgcccgccccccccgcccttcctgtccaccgcgggctctctgcagcagggcttgccgaagagactgctcccgacctctcatgtcatcctgcatccagagaacggcagcatatcaagccgttaaccctgattcactcggttcccttgaaaccaggcctcagttaaccatgaccacagctacaggcaaaccgctgctgttgctgcctgcttttgctgaagaatgatatcttgccaggcacggcggctcatgcctgtagtcgcaacactttgggagaccaaggcaggaggatcacttgagtccaggagtttgagaccagcctgggcaacatacagatgtctacaaaaataaaaatttgcaaggtgtggtggcatgcacctgtagtcccaactgctagggaggctgaggtgggcagattgcttgagctcaggagtttgagaccagtctgggcaacctggcaaaaccaaaaatacaaaaaattggctgggtgtggtggctcatgcctgtaatcacagcactttgggaggctgaggcaggtggatcacctgaggtcaggaattcgagaccagcctgcccaacatggcgaaaccctgtctcaactaaaaataaaaaaaattagccgggtgtcatggcgagtgcctgtaatcccagctactggggaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggaggtgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtaaagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431115 - DNA, 2207 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactgccttgcattgcccaacccatcacccgttcgggatcctcagagtgaccgcagc

SEQ ID NO: 431116 - DNA, 2205 bp, Homo sapiens
ttttttttgagacagagtctcgctctgtcacccaggctggagtgcagtggcgtgatctcggctcactgcaacctccgcctcccgggttcgagcaattctcctgcctcagcctcctgtaatcacagcactttgggaggctgaggcaggtggatcacctgaggtcaggaattcgagaccagcctgcccaacatggcgaaaccctgtctcaactaaaaataaaaaaaattagccgggtgtcatggcgagtgcctgtaatcccagctactggggaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggaggtgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtaaagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431117 - DNA, 2014 bp, Homo sapiens
acctatgggacttttaaacctgtatgccaggccccatccaaacttactgactcaaaatctccgggcatctgtttttttgtttgtcttgagatagagtctcactctgtcgccaggctggagctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggaggtgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtaaagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431118 - DNA, 1842 bp, Homo sapiens
cagcactttgggaggccgagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcacttcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431119 - DNA, 1479 bp, Homo sapiens
aggacggggcagtggaatccgtggatcatcctcataacatggtctgtagattccaccagacgcgagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccccaaggaaccaatggatgtcagtaggagtttctgttaaatgtctccttgatggggactcagtactgtgtaaagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431120 - DNA, 1633 bp, Homo sapiens
tccccccctcgaaacccagtcccccggaaacccatacttcaaacagcagcgcaggtgtatttaggattcagcaaatttaggacattgctgtagtggcatgtgaagatgagatgggccactggggcgtttctagtctgggttgctgctgcttaaggaaacctctcagaatccatttagcgctcggcgggcaagtgaggagtgagttttcctgaagggcccgctcccgtctcctcctgcggtgggtagtgagttttcttgagggcccgctcctgtctcctcccgtggtggtagttttcctgaggggcttgctcctgtctcctcccgctgtaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcacttcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431121 - DNA, 726 bp, Homo sapiens
cccacatctctgctcctgaagagccccgcctccaggacacacacaagcttcattagccactgtggtggggccaggagagttctgctctgcctcattcagcatctcctgagcttgtcagctgagtttttggtttgactgtcatctggtacagtgatgatgagagaggctgaacaatccccgggaagccagcagcaccctcggctaggagaggcctccatgcagtgtaagctgatcactttaggtctggaagccattggggaggcctggaaatgtcaaggtggccagtggcatatttgaagagttacttttcagagcacactaacactttaatttcctttggatttttctgtccaagtctaaatttcctctcccttcatcctacagaatggtgtttttggttaactgccatgttatgacaagggaggttagagcaataaatcagaacgtttcccttctagattagtgatccctgtttttaattgtctacacttggctgctggaggattattttacggtattgttttgctccagacaccaccaaaagggaggctggctgggaggaccagctctgagaaacctgtaaccatgtactttgcagctagccctgcattcattctttcccagcaccacaagggcaggagccaagagagcagagcttccaggagcagttctgaaatgatgcaatcaaatgtgtctggtcccttgattaaatgattgtaatagaat

SEQ ID NO: 431122 - DNA, 2958 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcacgctgtaaccccagcatttcgggaggcctgggcaggcagatcacctggggtaaggaatttgagagcagcctggccaacatggtgaaatcccatctctactaaaaatacaaaaattagctgggcatgggggcaggctaccggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtggctcacgtctgtaatcctagcactttgggaggcccaggcaggcggatcatctgaggtcaggagttcgagaccagcctggctaacatggtgaaccctgtctctactaataatacaaaaaattagccgggcgtgatggtgggcgcctgtaatcccagctactcgggaggctgaggcagaattgcttcaacccaggaggtggaggttgcagtgagctg

SEQ ID NO: 431123 - DNA, 3663 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcacttcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431124 - DNA, 3141 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacagctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagatgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431125 - DNA, 2228 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacccccaccctctccttgagtttctgtgaattaaaatatttgcaaatcca

SEQ ID NO: 431126 - DNA, 1814 bp, Homo sapiens
cgttgtctgcttggtgaccatgtggttccattctcctaagccatctcaacaggccagagtacacccttctgtcttcagccatttctctgctccctggttgccaagagcagcggcggcagcagagcagggcagtcagcaggagtcagtgtgagctcgtcaccaaaaccacccagggacatttacctgggcaaccggaaatggaattccagcttcccttccaccttttgtctaaccccgttacctgggcaaccggaaatggaattccagcttccagtccaccttttctctaaccccgttacctggcaaccggaaatgaattccagcttcccgtccaacttttgtctaaccccgtccgttgcatgagatgagtttgctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcacttcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctggcgacagagtgagactctatctcaaaacaaacaaaaaaacagatgcccggagattttgagtcagtaagtttggatggggcctggcatacaggtttaaaagttccataggtagttataacgtttacaccttgttaagaaccactgcaacagagagatttgctttatggaagggctcctgccacgcattttcatacatgtctatttttctgactctaagctaaaagtgcgccgacactacacttgagctggtgccaacgtggtgaagattctctactgataacagctttcattttaaacttgtgttgggtcaggcgcggtggctcacgcctgtaatcccagcactttgggaggccgaggtgggcggatcacatgaggtcacgagtttgagaccagcctggccaacatggcaaaatcccatctctactaaaaatacaaaaaaaaaaaaaaaaaaagcaggcaggtggcgggtgcctgtaatcccagctacttgggaggctgaggcaggggaatcagttgaatccgggaggcggaggttgcagtgagccgaggtcccgccactgcactccagcctgggagacagagtgagactcagttaaaaaaaaaagacttttggtggtggtggggaccatgcccaggattgggctctctccatactgatgaggattcttcttgttttgatgaccaacccccaagcagaagctt

SEQ ID NO: 431127 - DNA, 1453 bp, Homo sapiens
agcggctgacagagcggctgacggagccgggctcaccaggtcgctgccgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctggtaagaccttccctagggagctgccacgtgaaatcagtgggttgggtggttgggattcagggtttcactgtatggtgactctatccaggggatccggagttaagaccctcgttgaagggatatctaaaaaaatgatgtactgcgtaagagacaaacaataaatccacacagagtgttctgtatcatcactttcccagcag

SEQ ID NO: 431128 - DNA, 2228 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431129 - DNA, 2144 bp, Homo sapiens
  misc_feature (2131)..(2131): n is a, c, g, or t
gtactgcattcatgaagtaggctttgaaaattatacatcttggacaagtttttaagggatagtgggctttccttacacaactaaaataacctttccttcacataagttttcctgctagaaactttcaaacacatacaaaaatcagagaaaatacactgggtagtaacaaacatctctttttgttctatttctggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatggcgtcgttggcctcaagcggtggagctagttcgcccacgagcnccttctcctcttt

SEQ ID NO: 431130 - DNA, 899 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatagtaagtatctttcagtttctttccctatttggactgctaaccaaaatactgatacgactccgatgagtggagaaccccaggttcttcctcttgggtcgaattagaaaaaaatgacatggacacacatggagtagttttaaggagcagggagtttagtaggcaagaaagaagggggaagaaagaaataagctcccctgtacagagacagagggaggggagctccaaaaccaagagagggaaccccacctgccacggataccagtcaggtatatgaagaggctgaaggtgccagtgtttgatttgcatagggctcgggattggtttgaccaggcatgtcatccacatagcctgttaaaaa

SEQ ID NO: 431131 - DNA, 784 bp, Homo sapiens
tgctgtcatttcaccgatgacgtctagggttgcagggtcctttttggaagctcttgccgtcatcgctgacttgggcaatggggccggtggggtttgggggcggaagagaccctcggggttgagaagtatgtggtggcctttcgtcccctgtaaaacattgtcacacggtgtggggcggcagcgctggatctttgcaagtatacctgtggagggcggagctgtagccctctttattaccagtatcggagtatatactactacctgtctgacctcaggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaacttaaacggcactcagtatacttgggatttgttgtgattggcctggttctttagtgggtgctttgttccctgatggtcccataacaaaatctccgagtgggcaaggtgatcccatttgagactggactgccgggttagcgattggattaaaaaacctgactgatgaattg

SEQ ID NO: 431132 - DNA, 2236 bp, Homo sapiens
  misc_feature (2236)..(2236): n is a, c, g, or t
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatggcctcgttggcctcagcggtggagctctgccgccggan

SEQ ID NO: 431133 - DNA, 2254 bp, Homo sapiens
  misc_feature (2241)..(2241): n is a, c, g, or t
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatggcgtcgttggcctcaagcggtggagctagttcgcccacgagcnccttctcctcttt

SEQ ID NO: 431134 - DNA, 2124 bp, Homo sapiens
tgctgtcatttcaccgatgacgtctagggttgcagggtcctttttggaagctcttgccgtcatcgctgacttgggcaatggggccggtggggtttgggggcggaagagaccctcggggttgagaagtatgtggtggcctttcgtcccctgtaaaacattgtcacacggtgtggggcggcagcgctggatctttgcaagtgctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431135 - DNA, 2387 bp, Homo sapiens
tgctgtcatttcaccgatgacgtctagggttgcagggtcctttttggaagctcttgccgtcatcgctgacttgggcaatggggccggtggggtttgggggcggaagagaccctcggggttgagaagtatgtggtggcctttcgtcccctgtaaaacattgtcacacggtgtggggcggcagcgctggatctttgcaagttaagtaggcgctggcgttgtttacttgtcaccttctctgtatgttttttccctcattttccctacccttggggctagtgagtctccaacctctgtgcccattgtgtgattctgccttgatgacgtgagttgctcgttctgacttccaggtgtcacattctcttctaatctttttttgattggtgtagatacctgtggagggcggagctgtagccctctttattaccagtatcggagtatatactactacctgtctgacctcaggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431136 - DNA, 2118 bp, Homo sapiens
gtactgcattcatgaagtaggctttgaaaattatacatcttggacaagtttttaagggatagtgggctttccttacacaactaaaataacctttccttcacataagttttcctgctagaaactttcaaacacatacaaaaatcagagaaaatacactgggtagtaacaaacatctctttttgttctatttctggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431137 - DNA, 1790 bp, Homo sapiens
tgttcatcttcttcatcataaaggtcagctttcttctttgccagtcgctggttttcatccagagcacgaagctcgtggtctgaatacaggcttctctctatctcaatctgctgcagtagagacaaagggaaacaccggtgtttcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431138 - DNA, 2173 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431139 - DNA, 1995 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatatgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431140 - DNA, 995 bp, Homo sapiens
  misc_feature (8)..(8): n is a, c, g, or t
attttaanaataataattgttataagaatataatcaagagggaaaactgtttgtagtaaaggcaaaagcatattcagtggattagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431141 - DNA, 2192 bp, Homo sapiens
  misc_feature (2192)..(2192): n is a, c, g, or t
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagtggcctcgttggcctcagcggtggagctctgccgccggan

SEQ ID NO: 431142 - DNA, 790 bp, Homo sapiens
tttgtcactcttttctttccagttatataaaatcagaagaggtagaaccaggccccaagcactcctttttctctgcatgatacttctgcttattgtccttcacactagctacatgatttatagtcttgctccccaatatgttatgtatggaagccaaaattacttaatagagcctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431143 - DNA, 637 bp, Homo sapiens
agttcttttatgaccagtgtttgttaagcttttcgtattccaccgaaaaaagtttctagtatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatttgtatctgtgccttaggttctccagagtga

SEQ ID NO: 431144 - DNA, 2024 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggtaatagctatattcgcgttcatcgtgttgcgtgcttatagatgtattccaggttatagcagtatccgggtaataggcggtttcctgggt

SEQ ID NO: 431145 - DNA, 1774 bp, Homo sapiens
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatatacttctggtaatcattaagggattcaaccttctgggcaagagaggatgcgaagccgagaacggtatggtccggatactatctcaagttcggttttcaggggacaagggagggctcggggaggggggaagtccggagggaccgtggggaaacaaataaccctttggacttagtagcgattaacaatggccgggaa

SEQ ID NO: 431146 - DNA, 1530 bp, Homo sapiens
  misc_feature (1299)..(1299): n is a, c, g, or t
  misc_feature (1530)..(1530): n is a, c, g, or t
atgtcactgcgtccgcacgcgccccgcccctgagcagtccttgctgccccgcccccgctcggctcgccgccagggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctgggaaaacttaaggcattttttcttggggggtttcactaaaatttttggagctaaccctngatggttacactcctcaaacttggtaaaatttattggccttgttttttttttgggccccctttttactacaaaaacaggttttttttccccccccctttccttttttggggaaacttttttctaacttttaaatttttccccttttttaaattttaaaaacccaaaaaaatttttttaaacttttcttaaacttttttaatttgtactttatttttacttcaatggcaggn

SEQ ID NO: 431147 - DNA, 1090 bp, Homo sapiens
tgctgtcatttcaccgatgacgtctagggttgcagggtcctttttggaagctcttgccgtcatcgctgacttgggcaatggggccggtggggtttgggggcggaagagaccctcggggttgagaagtatgtggtggcctttcgtcccctgtaaaacattgtcacacggtgtggggcggcagcgctggatctttgcaagttaagtaggcgctggcgttgtttacttgtcaccttctctgtatgttttttccctcattttccctacccttggggctagtgagtctccaacctctgtgcccattgtgtgattctgccttgatgacgtgagttgctcgttctgacttccaggtgtcacattctcttctaatctttttttgattggtgtagatacctgtggagggcggagctgtagccctctttattaccagtatcggagtatatactactacctgtctgacctcaggtgctttcttttccaacgatcttatttctgcatattcagtgagcaaagtgtagatagaaatgtctcagagtggcctggctattacttccctgttcatattaaaaccctttggtttatttgggagttcaatttatttcctttcataacttctctaccttctcaaatcttctcttttctcatcgtccgaggctgtagttactttctgttctcacgtattttgacctttttgcattgcaaaacaaaaacctccagttctggaaatcaggcttgtttggttttactttaattgtcagatccagttggtgtctggtacctatgtagtatgttctagtagatttttgcagtagagactaaaaaaagaaaataaaagaaaagaatggtgtgaaaatttaagaaaaggatcctcttgttactgccatcactgtcacagataaaaacactgcctttaccctggaacatgttagtcctctcttggaggaaatgaaaccctaaaggttgactgtggtctctgcagccacccagtcctgtatttggagagccccctggcttttccagtccatcagatttagtttgtttagaaaaaaataaataagcatgtaatgtatgaaagttacgtgagactatcttg

SEQ ID NO: 431148 - DNA, 445 bp, Homo sapiens
ttttttttttaatatgtcatattaattggcagtttttaacactacattaaggtgattgaaagagtgggctttggagagagacctaagtttcagtaccatctctgacacttactagccatatgatcttagtcattagctttggttaataatcttttagagaaagtattaatcatcaattttatgaaagaacctatctcaccatagtcttttatttgctttcacagatcagtgtactgttacccggacatacctattccttcacaagttctggttcttcagtgctgcttactattttggtaactgggcctttcttggggtaagtgcagatatcccacgcgtgatttgaccttcctttataaattatagttaaatgtgtaaactctttttatcttactaggccatttgtatcatagtactgtcattgaattttaaagcattactttcc

SEQ ID NO: 431149 - DNA, 318 bp, Homo sapiens
cataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgat

SEQ ID NO: 431150 - DNA, 404 bp, Homo sapiens
ggacttcgaatcagaatattttgttcaattgtaatagccttcacaaatttagtttgtttctgtgtttaagtctcttttgacttaaaaaaaaaaatttgaggccgggcgcagtggctcacacctgtaatcctagcacactgggaggccgaggtgggaggattgcctgaggccagaagtttgagaccagcctgggcagcataacgaaacctccctgtacagaaaaaatttttaaaattagcagggcgtggtgatgtgcacctgtagtctcaagcttgagcggttgaagtgggaggaccctttgagctcaggagtttgaggttacagtgagctgtgatgaggcaactgcactccagcctgggcaacagagcaagaagactctgtttccctgtctcttaaaaaaaaaa

SEQ ID NO: 431151 - DNA, 4065 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgt

SEQ ID NO: 431152 - DNA, 587 bp, Homo sapiens
aaagaaagggaaagatttgcgtttaagagtattgtcaaccaaaaaaaaagaaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcatta

SEQ ID NO: 431153 - DNA, 5446 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttctttttttttttttccagagaattgggactgaatagtatgaaagtgaaaatggaaataaattaattattaatcatcatcatatcaataa

SEQ ID NO: 431154 - DNA, 3798 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcatta

SEQ ID NO: 431155 - DNA, 5261 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatgcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttctttttttttttttccagagaattgggactgaatagtatgaaagtgaaaatggaaataaattaattattaatcatcatcatatcaataa

SEQ ID NO: 431156 - DNA, 3078 bp, Homo sapiens
  misc_feature (3034)..(3034): n is a, c, g, or t
  misc_feature (3078)..(3078): n is a, c, g, or t
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcagcatttgcagcatctattcagaaagaatctaactataactgngagtgaagaagaaatttaaagttattgaaccctttgctctcaan

SEQ ID NO: 431157 - DNA, 4062 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtgggccgagatcgcgccactgccctccagcctgggtacacagcaagactccatctcgaaaaaagtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttctttttttttttttccagagaattgggactgaatagtatgaaagtgaaaatggaaataaattaattattaatcatcatcatatcaataa

SEQ ID NO: 431158 - DNA, 3613 bp, Homo sapiens
cgagccgaagcgcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatgcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcatta

SEQ ID NO: 431159 - DNA, 2083 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431160 - DNA, 3347 bp, Homo sapiens
  misc_feature (2279)..(2279): n is a, c, g, or t
  misc_feature (2467)..(2467): n is a, c, g, or t
  misc_feature (2523)..(2524): n is a, c, g, or t
  misc_feature (2612)..(2612): n is a, c, g, or t
  misc_feature (2697)..(2697): n is a, c, g, or t
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagagcagcctcctgaagtgagggtggcaagtatgtgacagggcacccacaaaggcagacgaggactctgagaaccaacaggacttctctggtcttattctgaggctaagacaaaaaccgcacctgagccagatctctcagcctggcagctccaggacccgtgggccctgccactggcccatctcaacggctaggacctagagcatcatcaagctgcaggttaaacaggttggttggttctgatttgactgcacctctacaaggacctatggctgcacttgttgatactttcccgaggagccacaacactgagcaatgaggggaggagcatgtgttagttcattcatcaagtcctaaatgttanctactatgtgccaggtgctgagccaggcaccagagataccatgatgaacaagacacataaatcttaccctcattgagcttacaccatgtgaaagagaagtatgaaataattatacgttatttttttttagtttttgagatggagtttcacttttgtcccccaggctggagtgcggtggtgtgacctcngctcactgcaacctctgcctcccaggttcaagcgattctcctgcctcagcctcccnngtagctgggattacaggcacctgccaccatgcctggctaaattttgtatttttagtagagacgggctttcaccatgttggtcaggctngtcttgaactcctggcctcaggtgatcctcccaccttggcctcccaaagtgctgggattgcaggcgtgagccacggcacctcacnaattacacattattcaactgtaactgtgaaagtgattctaaggaaaaagtacagagagctgtgggaaaacataataggaaatctttgtcattctgtcactattgtctattaggctgtcactgttgtcattgtcacccctaccctctcgcagagagtggttcccatttgccagagctcatttattgtcctgaaggtctgtgaaaagatgacaaagtcgtgttgccttctttccactttcccaagtctcacgtgagcacccctaactggcagaatcaattcacacccacaagcctagctgcaaggggacctgggaaatgtattcccagctttccaacctctccacccaggagatgaaacagccaatttaggccaggtgcaatggcttacacatgtaaaaccagcactatgggaggctgaggagggaagattacttgagcccaggagtttgagaccggcctggacaacagggcgagaccatcatctctacaaaaaatacaaaaaaaattagctaggcgtggtgtcctgtgcctgtggtcccagctcctcgggaggctgaggcaggaggatcgcttgagatcgaggctgcagtgagccgtgatcgcgccgctgcactccagtctgggtgacagcgagaccctatctcaaaaaag

SEQ ID NO: 431161 - DNA, 1893 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtaaaatgctatctccatgagaaaattcataaagggtgttttgttcctttgaaatgtataatgtaaagacattaaatctcctcatttaagga

SEQ ID NO: 431162 - DNA, 1835 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgaggttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431163 - DNA, 1436 bp, Homo sapiens
gtaaagcccttgcccttatagagtgtgtggtctcattgaagagcaagaacaaaatgtgcatatgtgaagagagatgtatgaatgacatccttaactccaggctgcagtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431164 - DNA, 1534 bp, Homo sapiens
acagtgggcagcctcagacctcagaaggacagcacctgcttggtccaaagggtatgagattcaggactgtttgtctaagctgtctgtggtcaaaagtacattctggactgaagagatggtgatgtaactgggctgtgtgtgtattgaaaaatccctctttgctctttcctcatttcagaatgacatccttaactccaggctgcagtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431165 - DNA, 1808 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggttgatgttcttaaggcaacagcactccctttgttgaaacaatttgggattgatggtgaatcatttgaactgaagaatgacatccttaactccaggctgcagtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431166 - DNA, 1123 bp, Homo sapiens
aaatcttctttggaaactggctggctgaaaggaagtactatttaatcagattcgatgagaaggtcttaacttcagccctctaggtctgggagattaaaaccttggattctaggtggtagaggataatttttttttgaatgaatttctttttatttatttatttatttttttcctttttaggatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431167 - DNA, 644 bp, Homo sapiens
gacagagaatagaaagtgttcttaggtgttgtgcttcagagggagcctggatcatgacccgcagagaggcaggtgtctttacaccttccaaaattgacttgaaccatttctaggggaagcgtgtgggtaggaagtcagggggtggggttgaggacctccagctttatactttccactgtctctattgtttgggtgtttttgccatgaccttttataataatgaaaaaaatttaattatggtactaattcagtaaattcagttggaaaacaatagatttggaagtcccagtttgttactacagttccacaaatacttgccagctttataactgatttttctctgtcctggaattcaagcagaatgacatccttaactccaggctgcagtactctgtacgtgtgtcacctcagatggcgaaccggattgtggattctgcaaggagcatcctcaacaagttcatacctgatatctatatttacacagatcacatgaaaggagtcaactctgggaagtaagtatctgtgtttttgaagtctgtttctgcagctttttcacatgcctgttctagttgaagttaaaactgccagctctgaggttgcgcagccagaggaagaacaatttcagaattaatttctttctgcct

SEQ ID NO: 431168 - DNA, 2216 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaaggatctaagtgtaataagtgtaatagagtcagggtctgggattttacccttgcaagctaataagttagattattacttttttattgatgctaccagaagacatgaggatcctgggtcagagataaagaactttact

SEQ ID NO: 431169 - DNA, 1907 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431170 - DNA, 1380 bp, Homo sapiens
gtaaagcccttgcccttatagagtgtgtggtctcattgaagagcaagaacgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431171 - DNA, 1395 bp, Homo sapiens
cgtggactgtcttttcagaggcctcgaatagcttgaacaaatgacatccttaactccaggctgcagtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431172 - DNA, 1496 bp, Homo sapiens
gtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccagtgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcatagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgttttttatattccaggtgtgctgtacattcttattttattttcacaatagctctgtgatgtaaatgctatctccatgagaaaattcataaagggtgttttgttcctttgaaatgtataatgtaaagacattaaatctcctcatttaagga

SEQ ID NO: 431173 - DNA, 473 bp, Homo sapiens
tttttagtagagacagtgtttcaccacgttggccaggctggtcttgaactcctgatctcaggtgatctgcccgctttgacctcccaaagtgctgggacttcaggtgtgagccaccacgcccagccaagaaattgattttttttagttaataatgtttaccaagtattgtagttgggtgaagtcttcaagcttaaaagtaaacctccagcatgttattacctaaggaatttgtgtcaaggctgattgaacctgaatctcttaaatgctttgtttttgtagagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatcctgtaagtaaaatgaaatccagtagaat

SEQ ID NO: 431174 - DNA, 2684 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccgttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431175 - DNA, 2767 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggtcagttctcccgcctgcccgccgcagtcgcagttgatggctggggtctgggctgtgcggggcgcagcggcccaaacccagtttgctcctggctctcgggagactggaggatttcatcggagccccgcgctttaccagccctgttccctggataagatatttgacctttccgacccgcggttttcttctccaatctcgctccgttgcccaggctggagtgcagtggcgtgatctcggctcactgcaacctctgcctcctgcctcagcctcccaagttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431176 - DNA, 2530 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcagaatctcgctccgttgcccaggctggagtgcagtggcgtgatctcggctcactgcaacctctgcctcctgcctcagcctcccaagctagagtgcaatggcacgatgtcggctcactgcaacctccacctcccgggttcaagcgattctcctgcatcagcctcccaagtagctgggattacaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431177 - DNA, 240 bp, Homo sapiens
tccgtctcaaaaaaaaaaaaaaaaaaaaaaaagaatgtttatcaaggtttaattctcttaagcgttgtaattaataagtttcatttttatcttattggcagggtaacaaggattaccatctacagacatgctgtgggagtctggcttatgcagcacctgagttaatacaaggcaaatcatatcttggatcagaggtaattattcattgattaattcattatataatcagcagacatttat

SEQ ID NO: 431178 - DNA, 2493 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431179 - DNA, 2349 bp, Homo sapiens
agatttgattcccttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgaggaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431180 - DNA, 1911 bp, Homo sapiens
aaaaaagaatgtttatcaaggtttaattctcttaagcgttgtaattaataagtttcatttttatcttattggcagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaac

SEQ ID NO: 431181 - DNA, 3943 bp, Homo sapiens
cttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaactcgtttgtctcatacctagtcccagacccccacaaaacatgttttgcagaacttctgccaactttgggatagcttacccccttcctatttgggaaaggttttattgcttgtagacccctcagaaggcagggtagggtgtacgtgggctgttctccccatctcagcctgggtcatgaacaaatgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggagcacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagatttagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttatggttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgagattgcgccactgcactccagcctgggtgaccgagtaagactgtctcaaaaaaaagaaagaaaaaaagaaaagaaattgtcctttggttgccttagttaccagagttgaatgaatgtacacatttcggtagtgggggggcagagcggataaccccttccttgtctgtttcctttgagaaaggacactccaccttttcaaaggtacttaaagccatctttacagattgcttgtaatgtaaggaaagagtcatgtcctttggattgattgaggttaaatcatcaaccactagccccctttcaaaatcagcgagatatttgatgattaagtgattcattgggtatgttctggctactgatgttactgaaatctgcaatcgtgtatgttttttaatttgttgcttttgtatttgtaattttatgacatttcgaagtttctgtgtcttaactctttttaattaattttctgcacgttgcttttttctctttgtttttaattccatacagagtattcaattcttgaaacacattaaaataatttgcttgctagggtatggtttattttataattacattcctagtcttgtgtggttattgtaatgatgtctggtcctaatttctctgcccgtatgaaaaagaaccccttgcctgttgatcctaaatataatttggaaattaa

SEQ ID NO: 431182 - DNA, 2982 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 431183 - DNA, 2225 bp, Homo sapiens
  misc_feature (1359)..(1359): n is a, c, g, or t
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccncaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaattt

SEQ ID NO: 431184 - DNA, 2871 bp, Homo sapiens
gggtccgggttccacgaaggccaggtccagtcagtttctcagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 431185 - DNA, 3095 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggaaaaacacgaacgaacgaacgcgaccagcgtcacaacacagacgcaccggaaccgacggagaccaacggaccaccagcaaccgaacacaccaccccacagaacaaccacgcagg

SEQ ID NO: 431186 - DNA, 3117 bp, Homo sapiens
  misc_feature (2935)..(2935): n is a, c, g, or t
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccgatgaatagctcgctattcatcggcaccggtcctgtgaatgatgaggaatcttcaacaaaaaagaaaaagaaggtagaaagcaaatccaaaaatnatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatcgaccctcctcagaatggg

SEQ ID NO: 431187 - DNA, 2021 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcgggttcagaaccctggagacctgaggccacaggcctttgttcttctgccttgggattttctgggcttgggagtctgaactgcaggccaggggccaagcgcggcaaagtcagaggcactaggagccagcagggcggccaccatccactggcgtgaagttccgtgtcctccggcacgaggccggcaggcccctccgcctcctgatgcagggcctgaggacactggtgtggtcctgtggatggggcccattctgccctgtgtcggaggcgcccttggctggctggggctgccctgggccccacagggctcaagttctgggtggaacagaaccg

SEQ ID NO: 431188 - DNA, 1953 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcgggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgcccgtccggctgtgccggaaaaccccgtccactcaacagcacagcctgcgcccgtccctcactggggctcttccctgcttgccggacacctggcttctttcagtggagtc

SEQ ID NO: 431189 - DNA, 1619 bp, Homo sapiens
  misc_feature (1196)..(1196): n is a, c, g, or t
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccncaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcactaattgggaggctgaggcaagagaatggcgtgaacccgggaggcagagcttgcagtgagccgagatctcaccactgcactccagcctgggcgacaaaacaagactccgtctcagaa

SEQ ID NO: 431190 - DNA, 2920 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 431191 - DNA, 2622 bp, Homo sapiens
agagtcttttatgcgatactgagtgccccgtatggttcgtataaaaatcggacgagggctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 431192 - DNA, 3017 bp, Homo sapiens
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgaccacgtggccgaggagctccagcatctgctgcagtggctgatgggtgctcccgccgggctcaagatgaaccgtgcactggaccaggtgctgggccgcttcttcctctaccacatccacctgtggatcagctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggctgtactgcctgaagatccatggcctgtcctcactgtggcgtctgttccgggggaagaagtggaacgttctgcgccagcgcgtggactcctgttcctatgacctggaccagctgttcatcgggactctgctcttcaccatcctgctcttcctcctgcctaccacagccctgtactacctggtgttcaccctgctccggctcctggtggtcgccgtgcagggcctgatccatctgctcgtggacctcatcaactccctgccgctgtactcactgggtcttcggctctgccggccctacaggctggcggctggcgtgaagttccgtgtcctccggcacgaggccggcaggcccctccgcctcctgatgcagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtgcagcgcgg

SEQ ID NO: 431193 - DNA, 1398 bp, Homo sapiens
ctggctgcaggctcacttgcctccttgggaactgggactggcttctcccacaggcaagggaatgtctgagacagcactggccctgcctcacaactgcccgcccccaccctctctctgcagacggggttggagctcagaccaccccactgaccgctgcccttgtccttccagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctgga

SEQ ID NO: 431194 - DNA, 2430 bp, Homo sapiens
  misc_feature (1196)..(1196): n is a, c, g, or t
gcgcggcaacgcgcggagccggcgggaagtggggctcgggtcccgcggcggggctggaggcagcgagcgccgtcgtctgcccgggcccgcccatcggggtccccaaccccatccggaccccgccgcccgagcgcgcggccccggaagcacccgcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgtctgctgttggccagcctgctgtcgctggtctcagctgtcagtgcctgccgagtgttcaagctctggcccctgtccttcctcgggagcaaactctccacgtgcgaacagctccggcaccggctggagcacctcacgctaatcttcagtacacggaaggcggagaaccctgcccagctgatgaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccncaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgctgccaagctcttatcctttaaatattaaataagctctatttataaagaatgttcttttctcagccgggggtggtggctcatgcctgtaatcccagcactttgggaggccaaggcgggcggatcatgaggtcaggagatcgagaccatcctggctaacacagtgaaatcccgtctctactaaaaatacaaaaaattagccaggtatggtggtgggcacctgtagtcccagctaattgggaggctgaggcaagagaatggcgtgaacccgggaggcagagcttgcagtgagccgagatctcaccactgcactccagcctgggcgacaaaacaagactccgtctcagaa

SEQ ID NO: 431195 - DNA, 856 bp, Homo sapiens
gagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcgggtaagtgctgcgtattgggcagctggccctgggtaggtggaggggaaccacacctgtgggccctgcagaagcaaggacagcatgggccactgtgcctccagcctggaagccgtggtatgcatgcgcaagcgggcagggaggacagggcctcctagtcccagaggtctgcaggaccagctgcctccagggaggtggagagagactcagagactcacctgccgcgcaggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgcccgtccggctgtgccggaaaaccccgtccactcaacagcacagcctgcgcccgtccctcactggggctcttccc

SEQ ID NO: 431196 - DNA, 1993 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaaaaaaaaaaaaaacaaaaaaaaaaaaaaaacaatgtgggccgcttgggccaagtgaattttaaattggagcaagtttttgcttggggccgaatttggggctaattgggccattccccttatggggggcggtttaaaaattaatgggcccggggtttaaaacggggggacgggaaaacccctggggttaccaaatttaatggcttggaggaatacccttttcgccagtgggggataagcaaaaaggcccaaccgatggcctttcaaaaatttgccaccctaatgggaaaggaaattggaaggtttaattttgaaaaatcgcgggaaatttgggaaaacagtcttttttacccaggggccaaagggaaaaccttttaat

SEQ ID NO: 431197 - DNA, 1083 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagggaggccggccaagggaaggcaaagaggccccgtccctcgggaaagg

SEQ ID NO: 431198 - DNA, 555 bp, Homo sapiens
  misc_feature (27)..(27): n is a, c, g, or t
ccaacagatattgtatctagtgcgttnctcgcttgttatttcagtcacgagggctccgttcattcccctgtatgtctacccatgctgtcgacatgcaagatgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatga

SEQ ID NO: 431199 - DNA, 1649 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431200 - DNA, 1608 bp, Homo sapiens
  misc_feature (1583)..(1583): n is a, c, g, or t
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggccccttttccagagctnaggatcctctagatcacccagcaac

SEQ ID NO: 431201 - DNA, 1598 bp, Homo sapiens
ctcttggggttggagggatggtcgagttgccaggcccacttttcccttatctttgtgggagtctgggacaccccagccctgtcctggctggtggaagctgccccaggtctctcaaggcctttccatttcatcccccagcttccctccttggagtttcatcctcatcacctcatccccatcttgccagtgctcccccgtcccacccgtccctgctctttcctgaccccttttctgttctccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431202 - DNA, 2253 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgttttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtcaaggctgcagtaagcctagatggagccactgcactcaagcctgggagacaaagtgagaccctgtctcaaacaaacaaaaaaggtcatggggctgagaagagtgtggtgcacgcccgccctgacacttcccccaatgctcggtggccacctgcagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431203 - DNA, 2713 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccggggtgaggggcgggacctgggcgagtccgggagagagtcggcggaccgcacgcacgcggctgttttggaggggcggggttcagctaaagggacgggatctgaaccccagggctccaaaccggcgaggggagcaggttggaggccaggcaaagaggagatttggccccgggtctggggtccgcggatagagaggcgactggggctctgcgaagttgggacgaagttaaaaggccacctggccaggggtagtggctcatgcctgtaatcatagcactttgggaggctgaagcgggaggatcacctgagcttaggaattcgagaccagcctgggcaacatggcgcaaccttgtctgtaccaaaaatacaaaataattagctgggcatggtggcgtgcctgtagtcccagcaacttgcggggctgaggcaggaggattacttgaacccagaaggtcaaggctgcagtaagcctagatggagccactgcactcaagcctgggagacaaagtgagaccctgtctcaaacaaacaaaaaaggtcatggggctgagaagagtgtggtgcacgcccgccctgacacttcccccaatgctcggtggccacctgcagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431204 - DNA, 1286 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcgggctgctgcgtcccaggactgagacgcaggccagccccggcccctagccctcaggccttctttcttatccaaataaatgtttcttaatga

SEQ ID NO: 431205 - DNA, 1616 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatga

SEQ ID NO: 431206 - DNA, 319 bp, Homo sapiens
gcacgaggtaaaacttcagggaggcaccagtgggtggagaaggcaggtccagtcctccagttttataagcaccaataagactgagagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatga

SEQ ID NO: 431207 - DNA, 2080 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaacaaaaaaaaaaaaaaaacaatgtgggccgcttgggccaagtgaattttaaattggagcaagtttttgcttggggccgaatttggggctaattgggccattccccttatggggggcggtttaaaaattaatgggcccggggtttaaaacggggggacgggaaaacccctggggttaccaaatttaatggcttggaggaatacccttttcgccagtgggggataagcaaaaaggcccaaccgatggcctttcaaaaatttgccaccctaatgggaaaggaaattggaaggtttaattttgaaaaatcgcgggaaatttgggaaaacagtcttttttacccaggggccaaagggaaaaccttttaat

SEQ ID NO: 431208 - DNA, 1646 bp, Homo sapiens
  misc_feature (1384)..(1384): n is a, c, g, or t
  misc_feature (1621)..(1621): n is a, c, g, or t
  misc_feature (1629)..(1629): n is a, c, g, or t
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaagaangcctgagggctaggggccggggctggcctgcgtctcagtcctgggacgcagcagcccgcacaggttgagaggggcacttcctcttgcttaggttggtgaggatctggtcctggttgggccggtggagaaccacaaagctctctggaggaaggacggggcctctgttctcttctacctggcccatcagcagataactgactcctttcttcatgggggggcactgcttgcaggtctgancggccgcnaatttagtagtagtagt

SEQ ID NO: 431209 - DNA, 2109 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtaccgaccctcctccccgggctgccctaggggacccaggcggcgccctccagcttgcagccagcagagatttattgaagatctgctgtgtcccgagcactgcgcttgcgctggtgggcacccaaaacagccccaacccctgcatgcacgcaaacaaaaatgtaaaaattacaactgagacaagtctcaggagagcgaggtacagggtcctggtataacacgcgggcctgtcacttgtgagtgcgccaggacttgaccttgccaaccacgacgaccgacacccctgcagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431210 - DNA, 1433 bp, Homo sapiens
ggtcggggaggggccagaagggggcgtccagccagttcctcctcccgcttccaccgcccgccagtgcgccctgcggccccagacttccccgagccgcgctcctcccggccgctctctgttaacctgcccccatcttacctccccttcttctcgtcccctcatcctgagccccagacatccgagctgcctgccggggctcccagcctagagttctcctgaagctgaccgagggtctccaccgccccccacccccgctcctctctcccctccccagagcaccaattttgcggggggcggctggagaaggcccagggaaccctgaccacgcccaactggcccgagtccgattaccccccgggcatcagctgttcctggcacatcatcgcgcccccggaccagggtcccatgggtgtgtgtggtcctccgtgctgtggtgtgaacgccttcaggaggggggcccagaggacgcgggaggtgggagtgggagctgctgcaggcacccagtaggagatgaggtgcaggcgcccaggggtgtcccgccgcgcagtccccgcctccgcccgccgccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431211 - DNA, 1347 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccagctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgtggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaatgggtcagatctccatgcttatggtattg

SEQ ID NO: 431212 - DNA, 600 bp, Homo sapiens
acaggtctgaatctatttgctcactgtgtagtgctttaggaatacaatttaacctctccgtgcttcagtttgtttgtccctaagatagagctaatgatagaaacctacttcacccagttgtgaaaattaactgactgcatgtcaagcactaacagtttctggcacatagtatgcataatgtaaattatgtgctgagaagcgagaaagaataacttgggaaaacgctgaatatcatcaatgtcgaatagctaaccagtagctaaggtccaaggtctcctctcttccttctatgtggcactcttgtttctggttcatctactccccttgggtgtcacctccttgagtgaagtacctgctggagatgagaagagtggaactggatctgcatgacagctttgattaggatggagctaagacttggctatctccctgttttgtgttttggatgggtgacattttaaaactgccaatattcaaatcctgctaatttgctttgtacagtttaaaatgtttgatatcttttgttgtttaaagtttgagattggttttgaatatacagttttcctacatcttgaagaaagttatgtttgtttactctga

SEQ ID NO: 431213 - DNA, 1349 bp, Homo sapiens
aaccgggcgtcccccagccgcgcccccagcgggaccgagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 431214 - DNA, 1378 bp, Homo sapiens
  misc_feature (3)..(3): n is a, c, g, or t
  misc_feature (18)..(18): n is a, c, g, or t
tangaaagctcgcctgcntttgggaatctccaggatcccccgcaaatttccttccactcgggaccgagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 431215 - DNA, 1008 bp, Homo sapiens
ggaggatcccaccatacgaggttctcatcccgctgatcgttatactccagtctggctgactgtggccacttgactggacttgtgtggtgtgactcatgataggctccgaaacgcatgcatagtgacagcggtgcgcggtgagcatgggcagttggtgtcaacacacatcgcgcgaatcgtgggtatactagaagttccaccttgagtggattgcggatcatcgggtggtgctcgcatgccgaatccctccaagacttacttgtgagcccaccagccctagcactggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 431216 - DNA, 1163 bp, Homo sapiens
aaccgggcgtcccccagccgcgcccccagcgggaccgagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggagcctctgcccgcaggtttctatgctgtttcttagcacagaatccagcctagccttagccgcagtctaggccctgcttggactaggactccttgcttgacccctcccttcctgggctgacctgctccctcgaggccagcctgctccctggctgaggctcaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 431217 - DNA, 1542 bp, Homo sapiens
  misc_feature (3)..(3): n is a, c, g, or t
  misc_feature (18)..(18): n is a, c, g, or t
tangaaagctcgcctgcntttgggaatctccaggatcccccgcaaatttccttccactcgggaccgagcgtgacccagctgcggccggccagccatggagactggagcgctgcggcgcccgcaacttctcccgttgctgctgctgctctgcggcccttcccaggatcaatgccgacctgtactccagaatctgttgcagagcccaggcttgacatggagcttggaagtgcccactgggagagaaggaaaggaaggtggggatcggggaccagggctaagtggggccactccagccaggagccctcagggcaaggaggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 431218 - DNA, 1140 bp, Homo sapiens
aagagaactgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggtagatttttgtcttgttcttcttactgtggtaactctgcattagaaagaaacaaatccatatgacatctcagtggccagatcttcatgtacctctttgtgtatgtgtgtggggggaggtgttatttgttatttgtgttgccagtcttatgaatggcccttagtttcaaaagatgtagtaacttccatgtttaaagttagaaggaaaatatttagatgcagcctaatctaaagaaaaaataatttgctgaattgagtaaagagtatcatcgtg

SEQ ID NO: 431219 - DNA, 843 bp, Homo sapiens
aagcgcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaagacactcaaaggtgagaatcagtcctaggaagattgtgagcaaccagtctacaatgcaaatactaagcaggctcaaaagcagatctataactacagctgcagctccatcaaggcaacaagtggacacatcctggcaaagtattttatatacaacgtttggtttgctccttccagaaactgtatgagaaaagtttgcatatcaaaatcctactgatgagaaagtggaactcaacaatgttaaatgacttgcctgcctaaggtcacacagttagtgacagagtctagatttcagcctagttttgttcaacttcaaagtccttgctcttatttgatggacacattaaattatccaccatggtatctagactgggacacagccacaatctgaaaattgaattctaatttaataaacgtgccctctgccaggaaatatgaggaatggctatagaaatgaagaagagtctctaccatgaaggagcttataatactaaatgttacactccttttggtctattaagtctaaggaaaagaataaacatctaatttcattcattcatgtaacaaatatcagtaatttttgtaatttcagagaacaatattataatttggaaggtgtttaggacaccttaggtagtttataataagaggtgatataaaatcatccatttcaaaagtcaattgtcaatgaatggagaatag

SEQ ID NO: 431220 - DNA, 4014 bp, Homo sapiens
aagcgcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431221 - DNA, 3535 bp, Homo sapiens
gtcagttgtgtgtcattaagcccttggattatatcttcaagtgtgccctttagttctgagaaatagacactttagaagtgtggtgaaagctgtgagtctgatgaactcatttccatgatttattttcctttacaggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431222 - DNA, 3014 bp, Homo sapiens
cttaaatccatgaggcccagtagtttgaatggtcactctgacatcatcaagtgaagatagtccatgtagagattagagcagaaatcatttcgggcccaaacccaaggatcacaaatgataaagaaatattcctcttccagtcaccaagggtttccctttgtgcatactggttgtccttggatatttttagaattgtccctaatatactctgcactgccagtgctctgggtagcatttgtgtgtcgcatcttccacattaccatgttatgtgttattttcactgccatcagaaaaccatttaatttttcaaaattaagtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431223 - DNA, 2977 bp, Homo sapiens
cttaaatccatgaggcccagtagtttgaatggtcactctgacatcatcaagtgaagatagtccatgtagagattagagcagaaatcatttcgggcccaaacccaaggatcacaaatgataaagaaatattcctcttccagtcaccaagggtttccctttgtgcatactggttgtccttggatatttttagaattgtccctaatatactctgcactgccagtgctctgggtagcatttgtgtgtcgcatcttccacattaccatgttatgtgttattttcactgccatcagaaaaccatttaatttttcaaaattaatttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431224 - DNA, 4392 bp, Homo sapiens
aagagaactgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaattttctctagtattcttcttctttgttccattatattcaaaatgcattaacattttccaaaatttttgaagagagatctttatttggacgtgtattcattaaatatataaagtagtgtttgaatc

SEQ ID NO: 431225 - DNA, 425 bp, Homo sapiens
cacttcaacatcaaccactttggccatccgtggcttaaacaacactttgcatttatgtatagaaccatcctgccaggtatagtgaggagtcagaagtgtgaaaacattaaactattgtaattttttctgattatgaaaatgagctagactaggcagagaaattaggtccttagagtttgtcatattgaaattaaatagatttttttaatcaaagaaaaattgaattcaagagttgcatatagccagaacattttggaggctaatgtgagtatttatgatttaggtattataaagtttggagggttatggattaaatacaatttctaggcccctcaatactttttttttatatatccaaacttgagtaatatacgaactcatcttcatcattgcaagcaaaatataaacatttgtgattacctgtc

SEQ ID NO: 431226 - DNA, 4267 bp, Homo sapiens
aagagaactgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431227 - DNA, 3015 bp, Homo sapiens
tgatctagaggatcccgtgtcgcaggcagatcctctgtacactctctctgcatcacactggagccaggatgtggcgagacacggcgatactccaaatccaacaacctgcagtcacctccaggacatgaggctctaacttttatctgagcgcttgtctgtgagggctgatccagccagcccttggcaaagaatggtgtaactttcctccccctcctgcgaacctatgtcataggttcgcaggggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431228 - DNA, 2807 bp, Homo sapiens
ctgggtatgtcaacatgactcaaaaggcaaccgtgttggtgtagatggttccatggaacactactacccaaagcggcatcgctcgtatacgctgcacacggcaatttctcagggattatagccgattgaaaaccgtccctcatccacacgtaggcactcctacatctgcattatccgtcgactgcgatgtctgactggaaaaccttgcgactgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaa

SEQ ID NO: 431229 - DNA, 4507 bp, Homo sapiens
aagagaactgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaacgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataacttaatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaaaaaaaaaaaaaaaaaaaaaaaaatttgtggggggctgggcccggaaaaagttttacacacccatctgtgggcccggggcaccagtagggtagtggaacgtcgccatagccggccccaagaaaacccggccaagacatagcgcgtgggattcccccaataaaaacgccggggcaacccaccgttgtgaaaatccgaagggatcagaggcaagggaccacacgggccaggaacgatatataa

SEQ ID NO: 431230 - DNA, 265 bp, Homo sapiens
ggagaatggccccaggtaaaacatggtagatgttaatttaaatatagtgggagtttattaattgtatgtatgtagacttactcatttggatccacagatagcaatatctgtggacacctatactaggtattgttagcataatagatgcagagtaaatacagtagccagtattaagaagtcctcttccccatgagatactctatggaattaaatgtattattcttttttattctccaaactctttgaaccaattttctctttgtgt

SEQ ID NO: 431231 - DNA, 505 bp, Homo sapiens
tccgggcgcggaggtttgcgcgcctgggtgagccgttggcgtggtggtcccggagtgatcctggcagccggtggggaagacaaggagggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431232 - DNA, 567 bp, Homo sapiens
ctactcgccgagttccctgtacgtgctgtgtccgatgacctgcagcgtggaagacaaggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431233 - DNA, 471 bp, Homo sapiens
cgctcccacccccatccgccatattcaaacgacaaaccgccgacgagactttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431234 - DNA, 812 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttcgaaaaaaacaaacaacccaaaaaaaaattttgtgggggcggcttgtggccctcaaaaaagttttttaaacccttctgttggggggccgcgggccccttggtgttcgggcaccttggtcctacgggttcccgaggga

SEQ ID NO: 431235 - DNA, 627 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 431236 - DNA, 1782 bp, Homo sapiens
ttttgagacagagtcttgctctgttgcctaggctaaagtgcagtggtgcgatctcggctcactgcaacctccacttcctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431237 - DNA, 1804 bp, Homo sapiens
ttttgagacagagtcttgctctgttgcctaggctaaagtgcagtggtgcgatctcggctcactgcaacctccacttcctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaa

SEQ ID NO: 431238 - DNA, 711 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431239 - DNA, 782 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 431240 - DNA, 469 bp, Homo sapiens
ccgtctcaaaaaaaaaaaaaaaaaaaaaaagagttcagataaatcacattgcaaatttttaaagatttatttgactgtgacaacctcctgtttaaaactgcacattcttacagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttt

SEQ ID NO: 431241 - DNA, 597 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttc

SEQ ID NO: 431242 - DNA, 493 bp, Homo sapiens
cgctcccacccccatccgccatattcaaacgacaaaccgccgacgagactttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaa

SEQ ID NO: 431243 - DNA, 833 bp, Homo sapiens
tccgggcgcggaggtttgcgcgcctgggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaacattcttcttggaagaggataattcggtgttgtgttagacagaaaaactgcgggggcgggacattggctggtgtatcgggggtataagatgtggaaccggtccaccg

SEQ ID NO: 431244 - DNA, 336 bp, Homo sapiens
cttagtccttagatcttctaccacagccccgctctctcgagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatc

SEQ ID NO: 431245 - DNA, 386 bp, Homo sapiens
ctggggattcttattgttttgatatttaaaaattgaatctggccgggcgtggtggctcatgcctgtactcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgta

SEQ ID NO: 431246 - DNA, 539 bp, Homo sapiens
  misc_feature (528)..(528): n is a, c, g, or t
ttaaaaaaaaaaagttctaacaattccattctgtaggtgagtgttagtattgtcattttataaatgagaaaactgaggctgaggcattaacttgcctaaaaggactcaggtggtgtgacaccacctgagtccaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttaaaagaggatagactctggtggtgtggggtnccgagctcggc

SEQ ID NO: 431247 - DNA, 375 bp, Homo sapiens
cttcgttgaatgtttatcagattataaatatagaggcatttcttcatcctgtttaatgtttattttgtaatcattggagtatgtgaaaaatttttgtttgttttgctttggtctctaagtaaacatgttcagcaaagtatttttttttttaagaaataaattgagatttgtatgttcttccttttaggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatc

SEQ ID NO: 431248 - DNA, 3305 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattagagcatttagtgacccctgcaggcatgttgcacttcccatactgaagccttgccagagtggcctcctgtagggtctgacttgggatcctgtccagccaaggaagcccttcttcagcctgctccagtgcccgcagttgccccctcagcatcccctcggggttctcatgtagatgggaacattttaactacgcggaaggcaggcatttcagcagaattaagtatagcgggggctcatctaataaaggaagccacttctcccaagtcgtcactcctttctgggcatgggttgtggaaagctctaaaacgttatgtgtagcagaagaaggggttggagggaagatttgtggggacaggttgtcttggattggccctgctgacatgtcatttgagagcagttttattttatcctttctaataggaattaggtattttactcctagaaacattattccttgagtacgcatgctgctcaaaggatgtagtcatttgtccactccattctagtcacagcaaaataaggattctttttggatcagtaataact

SEQ ID NO: 431249 - DNA, 1925 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgta

SEQ ID NO: 431250 - DNA, 2432 bp, Homo sapiens
  misc_feature (2432)..(2432): n is a, c, g, or t
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattattaccaaaaaaaaaaaaaaaaaaaaaaaaatttggggggggggggccgaaaaaaagtttaaaaccttgtggggggcggggcccaggttgaactgaggccaccgttggcgccaaagaacacccgcgcacggcatgggtgcgcgttctccccaaaaaaagcgcggcgcacggcgttcgaccaccagaggttcgcgcgctagcgggccaaccaggccaggtcgttatcccccgccggttgtgggccacccccacggccaccagccagcgcgaagcagccgagcacgtccaagcgcgcgacgcaaccgtacacagcacacaacagcaaagccgggaccaaccacagagacaagcgcctccagcgacccgaatgagn

SEQ ID NO: 431251 - DNA, 2582 bp, Homo sapiens
gacgcaggagccaatgagaaggcgcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431252 - DNA, 2838 bp, Homo sapiens
cagcggcctccccagcctgttatgtggagggggttctccgtcccacccaggtcaaagtgagaggggattgaggaggctgtcgatagggaaaacaggctcacgtttacagttgctgtattccggaaaacactccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431253 - DNA, 2752 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431254 - DNA, 2910 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaaggtgttttgttttaactcaggttgttcgtcgtgctaatgctaagttgtgactgagtttaaccatttttttaaaatatggttttgaaattactgaagttaggtattgacactttgtgaattcttttcagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431255 - DNA, 2859 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagaggaaaatcatgggagtaatgttgtgtgtttctcagtgtcagcgatccagagactcgtgctgtctctttgtccctttcctgatggtgttacttcgattaactacttcagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431256 - DNA, 2065 bp, Homo sapiens
agacatggctttcttacccacaagttctcaattatttgtataagtgtaattactgtattagctggaatatttattttcacttttttttttctcctttgtaattcttagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431257 - DNA, 2009 bp, Homo sapiens
  misc_feature (57)..(57): n is a, c, g, or t
  misc_feature (61)..(61): n is a, c, g, or t
aaacagtaaaactcttttaaaaatttttaacaaaatataaaaaaactagaatgaganactnaaaaattgccctgaagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431258 - DNA, 2023 bp, Homo sapiens
ttgtaatatcattccttattataagtagctcttacattcatttgaaaacacacaatcttggacttgaacgcaaaaattgcctttaacacagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431259 - DNA, 2037 bp, Homo sapiens
cttcgttgaatgtttatcagattataaatatagaggcatttcttcatcctgtttaatgtttattttgtaatcattggagtatgtgaaaaatttttgtttgttttgctttggtctctaagtaaacatgttcagcaaagtatttttttttttaagaaataaattgagatttgtatgttcttccttttaggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431260 - DNA, 2783 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431261 - DNA, 2903 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggagatatgatcatgtaaaacttacctacaatattcatttcaaactgctaaattagagcatttagtgacccctgcaggcatgttgcacttcccatactgaagccttgccagagtggcctcctgtagggtctgacttgggatcctgtccagccaaggaagcccttcttcagcctgctccagtgcccgcagttgccccctcagcatcccctcggggttctcatgtagatgggaacattttaactacgcggaaggcaggcatttcagcagaattaagtatagcgggggctcatctaataaaggaagccacttctcccaagtcgtcactcctttctgggcatgggttgtggaaagctctaaaacgttatgtgtagcagaagaaggggttggagggaagatttgtggggacaggttgtcttggattggccctgctgacatgtcatttgagagcagttttattttatcctttctaataggaattaggtattttactcctagaaacattattccttgagtacgcatgctgctcaaaggatgtagtcatttgtccactccattctagtcacagcaaaataaggattctttttggatcagtaataact

SEQ ID NO: 431262 - DNA, 1121 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatc

SEQ ID NO: 431263 - DNA, 2772 bp, Homo sapiens
aaacttaggtaggtacgaggccggtggttaattcggccgagggctgggcgaacacttcctgacctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431264 - DNA, 2573 bp, Homo sapiens
gcgcatatctgggacagtcaggccgggtgtgaatcggccgaggctggggcgacacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431265 - DNA, 2890 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaagataaattgaagaatgaaaaagaattacatagtgaaccgtcctcaaatgaaacccagtggaaagagcttactcagtattttggagtcaatgatagatttgacccgcctgttaaaaggaaaaaagttgagaagtcaggccttgaaaagaggatagaccaggctgtggaggagtggaatattgagaaggctgaggaactcagcaaccagctagctactcgagaggaaaatcatgggagtaatgttgtgtgtttctcagtgtcagcgatccagagactcgtgctgtctctttgtccctttcctgatggtgttacttcgattaactacttcagcttggtgtaaaaattgccaaagcagttgcctgccacaactttgtaaaagccaaaaaggaggttgaaaattcacaggctgcccgaaaaaagaagaaacttgcatgggggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgttatttgtataagaaatgtaagaaaaaaaatatagaaagaagaggataggattttgtttatttgtatggatggacccttggtataaaatcacttttggcgctttccattcatttggtttagcacagccagtgagcttctcgtactttctttcttttttttttttttttggagacagagcctcgcttgctctgtcacccaggctagagtgcagtagcacgatcttggctcactgcaaccactgcttcctgggttcaagtgattctcatgcctcagcctcctgagtagctgggattatggacaaatgccaccacacccggctaatttttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtgccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccggaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtat

SEQ ID NO: 431266 - DNA, 899 bp, Homo sapiens
gacgcaggagccaatgagaaggcgcgatgttgacggggtcctaagatggctgctgggcgaccacttcctgacagctccagttaatgggactgccagcaggctagacatccttcgccggaatgtgcagcgcttagttctgtgcccgggaggggcttctctctcttttgggattggagtgtggcattgccgccagaaagcctgcagaattccgggttgtgcagccaagcaggaacggtgtacctttctagacccatcctcttgcaatcttggaccctaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagaagaaaacgctccagaaaaggtgttttgttttaactcaggttgttcgtcgtgctaatgctaagttgtgactgagtttaaccatttttttaaaatatggttttgaaattactgaagttaggtattgacactttgtgaattcttttcagataaattgaagaatgaaaaagaattacataggtaggtagaatttaaaatagttatctattttaggccattgtagaaattgttgaactaattgtttctgatagtaatcaaacatatgaactagtaattgtagtataattgtagtaaccgattaaaaacagtaaaagta

SEQ ID NO: 431267 - DNA, 2189 bp, Homo sapiens
aattgaatcatgggtgcggtttcccccatcctattctcgtggtagtgagtaagtctcacgagatctgatggttttataagggattttccctttcacttggccctcattcgctcctgcctgccaccatgtaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagttgggtgtcgatgtccagagagttcctagaagccgtaattgaagacacaatccagtcatcctgggaccctaaatgacctccctgccccacccctgcacataaacctgacttgaatcacctggactatttttctgagagagtaataaactttaattgggtttgacctattccaagttttttgggctatctgttacagtgcttagcttatctcacctaatacagggactatgcaaccaagaaactggaaataaaaacaaagataattaaaccattttataataagccta

SEQ ID NO: 431268 - DNA, 1508 bp, Homo sapiens
tgtacatttcaacccaagtcttttagtattcgttcacctttcatttgaggagaagctaagtgctgactgccagaggatggaataggaagacaatggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431269 - DNA, 5802 bp, Homo sapiens
gcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtaagtacatagaactttgaacttgagacggaatgaaacaaattcaagcaaaaaccctgacagtaaccatgtccattcaaattgcgtatgccctttttatgttaaaagccgtgaatacttacaggacagtgggaatttaaaactaaatgaagggaagcatacaaaaggctgaaagcaagactgctttaaaaccggaggaaaattgaggaactgctaaggcaacctggcctgagttcagctgtgcaacaggcactttgggttttaatcttttgcgttcttcaatgctgttttcagactccagatatactttggtattgttttctctcttcctgcaaagctgaggcagagtcggactcctttactgtgagttgaaagatgtgagaataaggcattgctggaagcaacagtttggcagcctggggtacactcaggttattcgttacaactattattatttgatgtctttttttaaactcaggtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattatgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431270 - DNA, 5324 bp, Homo sapiens
gcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattatgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431271 - DNA, 5000 bp, Homo sapiens
gcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgaactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattatgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431272 - DNA, 627 bp, Homo sapiens
tgctacccagcagagcagcagagccaacacaatgtgcaggagaattgggtcttcctagcttctgacagcatccagagaagtttctgattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagttgggtgtcgatgtccagagagttcctagaagccgtaattgaagacacaatccagtcatcctgggaccctaaatgacctccctgccccacccctgcacataaacctgacttgaatcacctggactatttttctgagagagtaataaactttaattgggtttgacctattccaagttttttgggctatctgttacagtgcttagcttatctcacctaatacagggactatgcaaccaagaaactggaaataaaaacaaagataattaaaccattttataataagccta

SEQ ID NO: 431273 - DNA, 298 bp, Homo sapiens
gaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaaggtaagctctcggttgaagctattatttcacgtaagtacactgaagtaaagtaaagtgagttgggctgccattttcccacctttatggttatcaaatcccattgaacaaggatcacatcttttttattgc

SEQ ID NO: 431274 - DNA, 4356 bp, Homo sapiens
tgtacatttcaacccaagtcttttagtattcgttcacctttcatttgaggagaagctaagtgctgactgccagaggatggaataggaagacaatgaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattatgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431275 - DNA, 4469 bp, Homo sapiens
aattgaatcatgggtgcggtttcccccatcctattctcgtggtagtgagtaagtctcacgagatctgatggttttataagggattttccctttcacttggccctcattcgctcctgcctgccaccatgtaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattatgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggcttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggttgtctttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaatagtctgtg

SEQ ID NO: 431276 - DNA, 1595 bp, Homo sapiens
tgtacatttcaacccaagtcttttagtattcgttcacctttcatttgaggagaagctaagtgctgactgccagaggatggaataggaagacaatgaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggcaattcctttcaacgagacagatcaagaaccattgcacaaacaccaacgaaggtgccaagtttggatgcaagtagcaaagataaagcaaagcgtgcagatgtccacgaaagttaaaaacatggaaaatagagagaaaattagcatgtgccaggtggatggcatgcaggaaacgacgagccaatggtcgataattcgaaggcgaataatcgtatcgagcagacaagtcgcaacgagtgtgtggggaaaagcgtagacaacggttcgccttggaagcgttgtgttccaagttccccaaaacagggaagtccagacgatgacattgtaagtgttaacccgtgggtggaagagggatgcgacaccaagtgtgagggaattggagttggaggataaaagacgagaggtttgcaagccgacaaattatagggggaagaggtgggaggaaaaacacagtttgacactgttaaaatggcggttggggtcagattgggattgggcacaaaagaggggattggtcaccaagacccttgtggataaaag

SEQ ID NO: 431277 - DNA, 531 bp, Homo sapiens
ctcaacttaagcaagcgcttttatgttctagtcacttaccctagcacttgaggtttgtcaatttaattctcataacaaccccagaggaagataagaagataatatcgtcccttatttaccaactgggacaatttactgttgtccaagtgctctgggcaggacagaagggtgtgggtgtgctgcttccaggcttggaacaggaggtagaacaatgaacaatgacagaaagtattaataggccaggcacggtggctcacacctgcaatcccggcactttgggaggccaagaagggcggatcactcgaggtcaggagtttgagaccagcctggccaccacggtaaaaccctgtctctaccaaaaatacaaatattagctaggcatggtggtgcatgcctgtaatcccagctacttgggaagctgagtcagaagaatcacttgaatccaggaggcagaggttgcagtgagccgagattgtgccactgcactccaggctgggtgacagagctaagattctgtctcaaaaaaaaaga

SEQ ID NO: 431278 - DNA, 970 bp, Homo sapiens
gagcaaagtgttgaaggatccttacactatgtttgggtttactgagagtgctatgattgattagcagtgtccaccccattgggtacaggactaaatagtagcaacatgtgtagcatatttgtcaagaatcaggttttgatagtcctgtcaacactccagaagagaattagtttctctggcatggtaattaagaacttgggcattgaaaatagactgcctgggttcaaatcctgtagttcccatacttactaatcatgtgactttagaaaagttacataacttttctctaccccagactgtcaatctgaaaaatgagggtaacagtaacaacctgatagaccattattaggattgagtaatttcatctaaagcacttagaataaaggttagcacatagtaagtgctcattaagtattagggatggttgttatacattctacaaaattgatagattcattaaaataggatactctaagccaaactgaccttctgaagagaaattccacagtcatggtaaagttctattttttttaataggaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431279 - DNA, 1314 bp, Homo sapiens
caaaataaaaatggtcaataaagttgtttgtgtatccatatacccattttcctaagtacaaaaaatacctttttattagaaatgaacgaactcttacatcatttaatctcatacgttttcacgaactttaaaagttactttatttttaaagagaacttttataatccacagagaggaaatgaaaaaaatacagtgggattctggccaggcatggtggctcacgcctgtaatcccagcagtttgggaagctgatcacctaaggtcaggagtttgagaccagcctggccaacatggcgaaaccctgtctctactaaaaatataaaaattagccgggcgtggtggcaagagcctgtattcccagctacttgggaggctgaggcaggaggatcacttgaacccaggaggcagaggctgcagtgagctgagattgcgccactgcactccagcctgggcgacagcgagtctccatgtcaaaaaaaaaaaaaaaacgggattcttgtttgatcaaaacaaaagcttgcagttactagtattaaaagcaaacacccaacaaagtaaaaagcccaaacatgtatttgtactaaaacctgaatacacctatacatttaaagaagcattttacttagaattatattttcctgtggaaacttgagtagtgccaagagtatttacatctttgacatcacctttaccattcacagactacttaatcttagaatgtgtttaattgaaaggtaagcatacttaactgtagaatgatcaggttgttttaatagagaagaactttggtttaatattctaatatttaacaaaatacttttccacagaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431280 - DNA, 2074 bp, Homo sapiens
agcagcggtagtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431281 - DNA, 998 bp, Homo sapiens
  misc_feature (100)..(100): n is a, c, g, or t
  misc_feature (293)..(293): n is a, c, g, or t
gcgtcgttggtattcacgcggtctacgcgcgtgcgtgtgattagttgtagttaggctgcgatgtatggtgtggcttctgctgtgttgtgcgtgtagagtncacagtgatgtacagagaagcagtacagacctgggggtctttcgcaatctggttcccccgacatgtgtccactccctcgtaacagtcggcaactggatatttcgtgttttacgactttactgttatacgctggatagagtctggccggatccagaataatgagtgttctattatatataccacacacaacacntttgagctgatttgaccaatataaaagctttaactaagccggatccacctaaaccttcacgattatatcaaacagtggaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431282 - DNA, 562 bp, Homo sapiens
ttaatgaaacccagttcactacctggctcagcaaaattaaaggacccacccctctaagaaggtgaaggaggtagaattgtaaatacttacctaatagtgcatgtgtgtgtatttcccatacctattttattcataataaaagccatgggtgaaattttcattacggtttttctttattacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431283 - DNA, 797 bp, Homo sapiens
attgggttccaacattgtaactgtgacttttattcctgatgttgacaatgtggaatgagatgtattaacttataaatactgtgttgctcaagtgagactaaaagcacaatccatgccacctgcaccatagcccactttcagcataaagaaactcgaatgtattcttcaagtagtacacatcctacattggaagaatgttgttctaagattttataggtaactgttgctcctgtgaaatttgacagtgagattccttctatttttagtgtaataggaaatggcaccaatagtatgccatagtatatattttgggggacaaaaatactatgctcatttcaccactttattcctctttatttcatgcaattttaggtagatgtgtatactaaaatccaacagtatcccaaagaaagactgttaagaataacaaaaaaactagcatattaatctcttttcttgggaatattgaatatatttcttgttacttgtatctaagttctgactctgatttttacaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431284 - DNA, 2208 bp, Homo sapiens
agcagcggtagtggctcgtgggagccaagatggcggcggcggcggcagcgacagcagcagcagcagccagtattcgggaaaggcagacaggtactgacttattctcttctccttgaagcttcgtgactgccccgacgacatccttctcctctgtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431285 - DNA, 2137 bp, Homo sapiens
  misc_feature (29)..(29): n is a, c, g, or t
gcccacgcgtccggtcgccgccggcagcnaacagcagcagcagtcagccttcattcaggaaagacagccagttgctctcatgtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431286 - DNA, 2091 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431287 - DNA, 2088 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431288 - DNA, 1560 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggtaaatttaactttttcccccccacaatatgacttgcatttacatagggttttatactttgtaagatgctttagtattcattatcttattgagtccccactgtaacatgaagtataattatggaagacagcagtattatagttatttttttgcaaataaagtaacctaggaatccagaaagataagtgatttccaaggtcacatgtttagtaaatagaagtgggaatctatgatatttctattatattgcactgcctcaatatcactgctgtacatactactgtattaa

SEQ ID NO: 431289 - DNA, 1278 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggtaagagactaaatgcagcacttattactgaaatatagtaacatgcagtgttccctttaatttaaaattaacatcatggctacagaaacaaaaatgagaaggatggaactgagacctatgaacaaaacaagtgatgggatttggtattactgggtgtggatgctggaaaatgtgaagcattaaagtttagtttcaaatttatgatctttatagggtaaagtagtggttttgttggccatggaaaagaaggaaaagaaaacaattgaagaaaatggattattttgttttatttttaattttctaaccgaataagtaaataaatgtgttctcccttaggagaaaagcagtaatttctcccttttctctgggagtcagttaaacctcattttacgtt

SEQ ID NO: 431290 - DNA, 248 bp, Homo sapiens
aatcagctcggaccgatttgtgaatgtgatactgtgattgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431291 - DNA, 278 bp, Homo sapiens
cctgggtgacagagtgagatcttgtctcaaaaaataataataataattcagtgttttagtactaattgtagtgtacttgtattcgttgaaaaattctcttttcagaaaatgtctgcatcatagaagttagagttagtcagtagatattttaataccgtgacacccagagttagttctaataattagcttttaagtacaacttccttctttcatagggcttttaccaagatggcctcagctccggccagctatggcagcactaccactaaaccaatggg

SEQ ID NO: 431292 - DNA, 2174 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgttaattttctctgat

SEQ ID NO: 431293 - DNA, 810 bp, Homo sapiens
atttataatacatttttttattgacagcatagaagtcttcctattttattataacgttttctaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggaaaacacatataattttgtttgtgagtacttttaattgctcctatttcatattctttacgacatacttagaattatttcacaaataaccattttattataattatcggtacgctcgattatttttaacccatacttctacc

SEQ ID NO: 431294 - DNA, 2091 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatccggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431295 - DNA, 2030 bp, Homo sapiens
atgcgttgcgacttctcaacccaataataaagacgcaccgagtgtgaaatactcgtagcctgttgctgataactgatagtccagtatgtgagtactcgatggtcattcacttgcgtatctactcgaatctagtgagtctcatggcttgagctctcattattaacattatgtcccggccctatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaata

SEQ ID NO: 431296 - DNA, 2187 bp, Homo sapiens
  misc_feature (2148)..(2148): n is a, c, g, or t
  misc_feature (2187)..(2187): n is a, c, g, or t
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataacntggcctcgttggcctcagcggtggagctctgtgccggan

SEQ ID NO: 431297 - DNA, 1163 bp, Homo sapiens
agcagcggtagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggagaggtggatttgattgttcagctgcagagctgtggacttcagtcaaagggatggacattattttatctctgtttttttacttggcctttattttttcaaatcttaggttctctttttgtacctttcaccctctgctactgactcttattatttgaaacattaaatcggaagttatactaatagacatagggactttaattaaagtttacctttttttccagtcaagaataaaaaaaaaatggtttccaaataaatatgtattttttaaaaggttaaa

SEQ ID NO: 431298 - DNA, 141 bp, Homo sapiens
acaggaggaaaaaagaatataaagaagaaaggaaaaaaaggagtctgaaagttttcttcagaggcttcatcattctaaaacttataggagtgctttcctaaaattatgggaatatgaggacaagaaagaaggtaagcaagg

SEQ ID NO: 431299 - DNA, 2427 bp, Homo sapiens
  misc_feature (1332)..(1332): n is a, c, g, or t
cgcccaggcgcttccgcgaccacccggagtgattgcccggcagagcgcgatactcgtttgtagtttcataaacattgatgttgggtcaatcatgttctcaatgtatttaaccatgtgtttttaaattttttaatttagttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcagattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaangcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431300 - DNA, 855 bp, Homo sapiens
ttttttttttttctacctaggtaaccttcaatttattctctgttgttatatcttatttttctttctcacatttgcacttatgattttttagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaataggtaagtagtgtaaggagttttgttgttttaaacctaagcatcctgttcgattttggagatatatgggacttagaagcaatagaagttctctgggaaatgcaaaatgggaatgggtcccttccctgaagggcaagttgggggttagcagcagagccgttgagtcaagactgttctgggtttaagtctcaaatattagccacgtagtagcagaatatcctgggcagaatatttaacctttttctgcttgcttcttcctctgtaaaatgatagtaatattgacctcaaagacttacttaaggtctaaataaaatagtacctggaacgtaggaaatgctcactaattgttagctactactataacctaggcttgtactgtccaaatatagtagccactagaccatgtggctatttaaatttaaattattaaaagtttaagaaaattcaattcctcagtcacattgtaagtgctcagtagccacatgtggctcatggctgccaaattggacagcaccattataaagatttccacatcacagaaatttctcctggacagcactgacaagagactccaagtcctccgtccttacag

SEQ ID NO: 431301 - DNA, 2338 bp, Homo sapiens
  misc_feature (1243)..(1243): n is a, c, g, or t
cgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcagattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaangcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431302 - DNA, 876 bp, Homo sapiens
cgcccaggcgcttccgcgaccacccggagtgattgcccggcagagcgcggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431303 - DNA, 2459 bp, Homo sapiens
  misc_feature (1243)..(1243): n is a, c, g, or t
cgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcagattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaangcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431304 - DNA, 2389 bp, Homo sapiens
  misc_feature (1243)..(1243): n is a, c, g, or t
  misc_feature (2346)..(2346): n is a, c, g, or t
cgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcagattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaangcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagtaaacaaaanaagaaaagaagaagaaaatgtgtcgggggagacacgcgtaaga

SEQ ID NO: 431305 - DNA, 1062 bp, Homo sapiens
acatattttatctcttttaattgtattctgtagctaggagcttgggttcttggaagtcaatttcattggtggcaagaggagggcataattaattctaacaagttcatttcatagtgtcatttaaaaatagaatacttctgtctggagtgtgtaaattgatgttgaatgttcatgatgttctctcatacatacctcaattcagacgtaactatgactgggatgctttctgtttcaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431306 - DNA, 953 bp, Homo sapiens
ttttttttttttctacctaggtaaccttcaatttattctctgttgttatatcttatttttctttctcacatttgcacttatgattttttagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431307 - DNA, 997 bp, Homo sapiens
cgcccaggcgcttccgcgaccacccggagtgattgcccggcagagcgcggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaatagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggatagcactgtgtattgatggtccaaaaaggttttgctccaatagcaaacacttactggggaaagaagctattaaacaaagacacctacagttactcggttatcaagttgttcagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagta

SEQ ID NO: 431308 - DNA, 2361 bp, Homo sapiens
  misc_feature (1243)..(1243): n is a, c, g, or t
cgcccaggcgcttccgcgaccacccggagtgattgcccggcagagcgcgttatcaaattgagaatctgatggtatggcattaatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcagattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaatatgtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaangcagtggcagaaacttttgtttgccaaacagaaaaattttcacctcgtcagatttctgcgttaatggaaccatttgggaaactcaattatttgccaccaaatgcctctgctttatttagaaagctggaaaacgtgctattcactcatttcaattattttccacccaaatcattattgaaacttcttcattcatgttcacttaatgaatgccatccagtcaactttctggcaaaaatattcaagcctcttttccttcaacggctgcaaggtaaagaatctcatttggacacattgagtcgggcacaactgacccaacttttcttagcctcagtcctggaatgccctttctataagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaataggtaagtagtgtaaggagttttgttgttttaaacctaagcatcctgttcgattttggagatatatgggacttagaagcaatagaagttctctgggaaatgcaaaatgggaatgggtcccttccctgaagggcaagttgggggttagcagcagagccgttgagtcaagactgttctgggtttaagtctcaaatattagccacgtagtagcagaatatcctgggcagaatatttaacctttttctgcttgcttcttcctctgtaaaatgatagtaatattgacctcaaagacttacttaaggtctaaataaaatagtacctggaacgtaggaaatgctcactaattgttagctactactataacctaggcttgtactgtccaaatatagtagccactagaccatgtggctatttaaatttaaattattaaaagtttaagaaaattcaattcctcagtcacattgtaagtgctcagtagccacatgtggctcatggctgccaaattggacagcaccattataaagatttccacatcacagaaatttctcctggacagcactgacaagagactccaagtcctccgtccttacag

SEQ ID NO: 431309 - DNA, 3201 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431310 - DNA, 2095 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacatt

SEQ ID NO: 431311 - DNA, 3177 bp, Homo sapiens
tattcatctgtttttctttttcgttggtgtaaagccaacaccctgtctaaaaaacataaatttctttaatcattttgcctcttttctctgtgcttcaattaataaaaaatggaaagaatctaaaaaaaaaaaaaaaaaaaaaaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagtcacaactgtggagagactatgaggccctgaactttggcgttaccaatgaaaagggaatggattcaaggccaggcatggtggctcacgcctgtaatcccagcactttgggaggccgagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431312 - DNA, 3060 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431313 - DNA, 3159 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactatggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431314 - DNA, 3059 bp, Homo sapiens
tattcatctgtttttctttttcgttggtgtaaagccaacaccctgtctaaaaaacataaatttctttaatcattttgcctcttttctctgtgcttcaattaataaaaaatggaaagaatctaaaaaaaaaaaaaaaaaaaaaaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431315 - DNA, 3375 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaagcaccacccagaagctgtccacatcaattatattcatcttccattggccagaaatttggctttgcggttgggaagtgttggtatttagctaagtgttggcatcattagtcttagccagatgctacttgcccagcagataattcaactatcaaagaagaaggagagaatggccagactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431316 - DNA, 2133 bp, Homo sapiens
tcaggatctggctttctgtgaatttaggaaactcctaatagtatctttagttttccatttcttttcctttcaaagaaaaacatttttctttatctctttagaagaagtgaagagttgcttggcctaggtaaggtagctgtcttgaaatatttgaatattgtctgtttatggtgtttggacaaattaatagttaatgaaagtaaatgcaagttatagaactctaaaacctttctttataggttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431317 - DNA, 1992 bp, Homo sapiens
tcaggatctggctttctgtgaatttaggaaactcctaatagtatctttagttttccatttcttttcctttcaaagaaaaacatttttctttatctctttagaagaagtgaagagttgcttggcctaggtaaggtagctgtcttgaaatatttgaatattgtctgtttatggtgtttggacaaattaatagttaatgaaagtaaatgcaagttatagaactctaaaacctttctttataggttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431318 - DNA, 1631 bp, Homo sapiens
acaacagtattttggatagaattcttatgcaagttaaattagctttacttatgcaaagttattaatgagctttttgaattttatttctcttttaagttctgatgaaaagaaagggccacaaaaaagttttcttatattgtggttcttggtgtaagatgagcgcttgctaaatgccactttcgttccaagtcatcttgtttgcttgcagactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccagatttggaacatgcgttgaaatgtcttcagcgtgaagatcccagtttgaaagtgaggctagatcctgactctggacaaactgttctgtgtggtatgggggagttacatatagagattattcatgatcgaatcaagagggaatatggactggagacctatctcgggcctctccaggtggcatatcgagagaccatcctaaactcagttcgtgccacagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431319 - DNA, 2280 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacatttcttgtggttggtcttgttttttaagatgttttgatttttacaaatgccttcatttttttcctcttcttatttcttggccattcttctcatattatattcttccttactcttgtagtgctatctatgggattctaagtaattggccttagaactgcccttctagtatattagattagacagtaactgattcataaccaattcagtttgtcatcatcatgtataaaaatgctgttttaccttgttttctacctcaacctctagaactcaatgaagatatttatatactgtggataatcttgtttgaccttttgttagtaactttgtt

SEQ ID NO: 431320 - DNA, 1692 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagtaaagtataatgaatgataaaatgaacaccaatgtgtgcaccacttatcttaaaatatagtcatactttagcatctctcggggattggttgcaggacctcctgtggataccaaaatctgcagatgctcaagtccctgatataaaatgatgtagtatttgcatataacctattgatgtcttcctctatactttaaatcatttctaaattacttataatacctaatacaatgtaaatgctatgtgccattttttgttcatctctctctcccactaatcatctacctgtcccccaaattattatttcaatatttctctttcatttgcttttcgttgagatggagtcttgctctgcggcctaggtgacagagccagactccgtatcaa

SEQ ID NO: 431321 - DNA, 1325 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagataccttagatagaactttaggagacaaaaggcatcttgtgactgtagaagtggaagcaaggccaattgaaacatcatctgttatgcctgtgattgagtttgagtatgctgaaagtatcaatgaaggccttttgaaggtctcccaagaggccattgaaaatggaattcacagcgcatgtctccaaggaccattgcttggatccccaattcaggatgtagcaattactttacattccctgacaattcatcctggcacctccacaactatgatttctgcctgtgtctcaagatgcgtgcaaaaggctctgaagaaagctgataagcaagttttggagcctctgatgaatcttgaggttacagtagctagagattatctcagccctgtcctggcagatctggcacaaagaagaggaaacattcaggaaattcagactcgccaggacaacaaagttgttattggatttgttcccttagcagaaattatgggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431322 - DNA, 1228 bp, Homo sapiens
  misc_feature (1074)..(1074): n is a, c, g, or t
  misc_feature (1105)..(1105): n is a, c, g, or t
  misc_feature (1174)..(1174): n is a, c, g, or t
  misc_feature (1177)..(1177): n is a, c, g, or t
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaaggctttaanttttccgttgaaaacctccgaaaaaaatttnaaggccaacccttgcttttccctttcccattggtgaaacccaacttccaaggattggggattttttatnaanaaaactcctttgaattccatccataaggaaaaattgaaaaaccccctgaat

SEQ ID NO: 431323 - DNA, 1241 bp, Homo sapiens
ctccttaccatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaattgatacaccaggtcatgtggactttaccttggaggttgagcggtgcctaagagtgttggatggtgcagtggctgtatttgatgcctctgctggtgtagaggcccagactctcacagtatggaggcaagctgataaacacaatatacctcgaatctgttttttaaacaagatggacaaaactggagcaagctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaaacagtc

SEQ ID NO: 431324 - DNA, 851 bp, Homo sapiens
acaacagtattttggatagaattcttatgcaagttaaattagctttacttatgcaaagttattaatgagctttttgaattttatttctcttttaagttctgatgaaaagaaagggccacaaaaaagttttcttatattgtggttcttggtgtaagatgagcgcttgctaaatgccactttcgttccaagtcatcttgtttgcttgcagactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacatttcttgtggttggtcttgttttttaagatgttttgatttttacaaatgccttcatttttttcctcttcttatttcttggccattcttctcatattatattcttccttactcttgtagtgctatctatgggattctaagtaattggccttagaactgcccttctagtatattagattagacagtaactgattcataaccaattcagtttgtcatcatcatgtataaaaatgctgttttaccttgttttctacctcaacctctagaactcaatgaagatatttatatactgtggataatcttgtttgaccttttgttagtaactttgtt

SEQ ID NO: 431325 - DNA, 309 bp, Homo sapiens
attaattaaaaataagtatgtattaacatcatacttttatatagtattctgcaataaatataatttacccttaatcttttatttcattcctctggtaaccagactgttctgtgtggtatgggggagttacatatagagattattcatgatcgaatcaagagggaatatggactggagacctatctcgggcctctccaggtggcatatcgagagaccatcctaaactcagttcgtgccacaggtaaaaagtaaaacatttaggatttgctttttctctctttctgtctttctttctctatttagttgctg

SEQ ID NO: 431326 - DNA, 410 bp, Homo sapiens
acagcacgcgctaacaagatcacagttcgcttccactcagatcagtcctacaccgacaccggcttcttagctgaatacctctcctacgactccagtgaccgtgagtgaacattgttgggaggagggctggcgggggcctgcaccgcatgttctgtccaccctgcatctcgttagcatcgtgctttgctgattctatactgcggagagaggtcccagttcgtcgtcaccagcaacagcaacaagatcacagttcgcttccactcagatcagtcctacaccgacaccggcttcttagctgaatacctctcctacgactccagtgaccgtgagtgaacattgttgggaggagggctggcgggggcctgcaccgcatgttctgtctaccctgcatctcgttagcatcgtgcttt

SEQ ID NO: 431327 - DNA, 380 bp, Homo sapiens
tgtttgtgcatgcgcgtaatgaagatagcaacaccttaagcccagtggtgcttaaggcacgtgagggggtgggtatgaagggaagcaggccgttagttggcaaatgctagattgaaagaatccactgtacagcatatgctgaacatttgtcgtctttggagaggaaagaaaacgaacaggacttacagctccaatgccctcacagaaccccgcgggcatttgcggcgccttccctccgcctctctgcttcttgttccctcacccctgcttgccacggcgtctgttccctctcaactcgcctggcagatctcagcatgcccctgcttcctctaggtggctgctattgccagagcccactgagtagacgcggattacccgtt

SEQ ID NO: 431328 - DNA, 3531 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431329 - DNA, 3394 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431330 - DNA, 2057 bp, Homo sapiens
ctctccgctatttctccccattgatctccgcgtactcctggggcatgtgcccgcaggcacgccgggctccggcaggtagaacaatttgaagcgcaccttcacattctggttgttgggcacctcaatgttaccatgtgcattcaatgttcggtgggtactggcctgggtatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431331 - DNA, 3583 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaatatttttttttgttttttttttttttatatattattatttttttacacatta

SEQ ID NO: 431332 - DNA, 711 bp, Homo sapiens
  misc_feature (3)..(3): n is a, c, g, or t
  misc_feature (6)..(6): n is a, c, g, or t
  misc_feature (28)..(28): n is a, c, g, or t
  misc_feature (50)..(50): n is a, c, g, or t
gtngtngggcttcctcagcggcggcgangaacctcctgccgcagcagaantacgccgcgcatgatgtgcgtgactggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431333 - DNA, 2222 bp, Homo sapiens
  misc_feature (1889)..(1889): n is a, c, g, or t
  misc_feature (1897)..(1897): n is a, c, g, or t
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcctcccagaacgtcctgctcatcacactgataaccaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcacnttccgcanctttgaccttgcgtcctgcgacgagcgcggcagcgacctggtgacggtgtacaacaccctgagccccatggagccccatgccctggtgcagttgtgtggcacctaccctccctcctacaacctgaccttccactcctcccagaacgtcctgctcgtcacactgataaccaacactggcgaggctaggacactggcgaggctaggacactggcgaggctaggacactggcgaggctaggacactggcgaggctaggacactggcgaggctaggacactggcgaggctaggacactggcgagggctaggacactggcgaggctagga

SEQ ID NO: 431334 - DNA, 372 bp, Homo sapiens
cccactgagtagacgcggattacccgtttgtcagccccgggcatctgggctgttccagagttttctagtccaatgacccgtggggagcgtctcgaatgacgctgccctcgaagcagcccggctctcagccccgtcctgccctctccccaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccaggtggcccccggggcaggagggcggcaggtgggccccgggagaggcgggactggggactcacggcagggcttgtctccgcccaggg

SEQ ID NO: 431335 - DNA, 197 bp, Homo sapiens
ggtgcttccctcatctctcccaactggctggtctctgccgcacactgctacatcgatgacagaggattcaggtgggtctctgggtgggcagcagggagcctccttgctggccctttgcatctgggagtaatgccaggataggttggcaccgaggcagggcactggaggggtggccacatgtgttagtccattcttga

SEQ ID NO: 431336 - DNA, 593 bp, Homo sapiens
gtcacttgtaccaaacacacctaccgctgcctcaatgggctctgcttgagcaagggcaaccctgagtgtgacgggaaggaggactgtagcgacggctcagatgagaaggactgcggtgagcagggcatccgagtacggttgtgcaggttgttcactgtgtgaagtgcccaccagagggtgcacctggaggtgcaatcccgccagcacctcacttagcagctctgtgcttgggtgagagggtgtgtctcctggaggaaaggatagccttgccagttggcatgaaggcaccaccccacgggctggctctggtcttggagaaaggcccgtacggccagcatctcagcgcctctgtagcatggcggggtcgtggctgcagtgcgttgctggcccctgctgtgtagacacagctgtggagcagtagcctggagaagagcggcccagctcacccaagcccaaggcagggtgtcacccctgcctgcccatactttaatctgcagcctctgtgtttcagaagcgttggctggccacaggttagatttgagcacagctccagcgttctgtgacctcacatcagcggttcattcgtccctctc

SEQ ID NO: 431337 - DNA, 2289 bp, Homo sapiens
ttcagctcggacccacaccacctgagtccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431338 - DNA, 3471 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagcctgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaa

SEQ ID NO: 431339 - DNA, 3766 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaaaaaaaaaaacaacaaaaaaaaaaaaaaaacaaactcaaaaaaacagcaacacgaaaacaaaaaacaacaaaacaagaagagaaaaaagaaagaaaaacaaaacagaagaaacaacacaacacaagaagagggcgagcgccacacaataaatccaccaccggaagagcaagccattaagaaacagcaccacacaacgttaataagaacgagccacacgcccacacacaagaagagg

SEQ ID NO: 431340 - DNA, 2480 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctggctgatgaattcgaattcatcagccagcagtggacctgcaaaatcctgacctggtgtcactcctgttgaagtgtggggctgatgtcaa

SEQ ID NO: 431341 - DNA, 1833 bp, Homo sapiens
gggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcctgggacagtgttgtgtgtggcgatccagtgctgctgtgacgggcgtagatcttc

SEQ ID NO: 431342 - DNA, 329 bp, Homo sapiens
actggtggttctactgacccaactgggggcaaaggtttgaagacacagcctcccccgccagccccaagctgggccgaggcgcgtttgtgtatatctgcctcccctgtctgtaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttcttttt

SEQ ID NO: 431343 - DNA, 1031 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaggtgttcagggcacttcttgtcctctctgtcccataacctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431344 - DNA, 1182 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggaatttcatttcctgtattttatctggccaccctaccttaaacggatttttatgcccaatgcgtctccaaacgggctgcccccaactccctgagctgcctttatggaaggaggagcaactcttcaggatgcgggtctgttgtgggtgatttcgtttgcccagtttagttttatttgaatcagttcacaagtacctgcgattagaaaaggcttaagatgggaggccaaggtggggaggtcgcttgagcccaggagttccagaccagctgagcaacctggcaaaacctcatccctacaaaaaatgcaaacattagctgggcataatggtgcacacttgtagtcccagctactcaggaggttggggtaggaggatcacttgagcccaggaagtcgaggttgcagtgagctgtgattgcaccactgcactccagcctgggcaacatagtgagaccctgtctcaaaaaaa

SEQ ID NO: 431345 - DNA, 389 bp, Homo sapiens
  misc_feature (19)..(19): n is a, c, g, or t
  misc_feature (21)..(21): n is a, c, g, or t
gaaaaaaaaaaaaaaagtntntccgcgaattcggcacgaggccgtaaccgcgccctttctacctctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431346 - DNA, 1308 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaggtgttcagggcacttcttgtcctctctgtcccataacctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431347 - DNA, 1464 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaggtgttcagggcacttcttgtcctctctgtcccataacctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctggaaaaaaaaaaaaacaacaaaaaaaaaaaaaaaaaaaaaaacaaaaacaccaaacaacacaaacacacagaaacagagacaaaaccaccaggcaccgcgcccacacagacaacacgcgccgcacgacccacgccccccccgccagagggacccacacg

SEQ ID NO: 431348 - DNA, 1154 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431349 - DNA, 1136 bp, Homo sapiens
agcggggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaaaaaacagcaacaaaaaaacacagaaaaacacacaaaaaaaaaaaaacaacaaaaaaaaaaaaaaaaaaaaaaacaaaaacaccaaacaacacaaacacacagaaacagagacaaaaccaccaggcaccgcgcccacacagacaacacgcgccgcacgacccacgccccccccgccagagggacccacacg

SEQ ID NO: 431350 - DNA, 1250 bp, Homo sapiens
taggggtcagtacgaggcctggtggttggtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaggtgttcagggcacttcttgtcctctctgtcccataacctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431351 - DNA, 999 bp, Homo sapiens
cagctcgcacacactgccaaagtatttgtctaagagctccacgtatcggtggatcagctccagtgtgatgagctcttagacaaatactttggcagctgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcacctcagatgtccttccctccctaataactgtaaatatataaatatgtcaggttaaagggaaaaggtgttcagggcacttcttgtcctctctgtcccataacctacctccacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctgga

SEQ ID NO: 431352 - DNA, 2154 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431353 - DNA, 2372 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggtttgcccccactctcagctcacctcccagcctgcccccagccaaggcagtccagagcctgcagcctcatacagactggccctccctgtggggcccagagcccaaagtgacctggcagggctgccgtggcctcccggagcaggaaggggcctctgtccaggggtgaacaagggtagggcaggacctcttctcttctcccttcccctccaatcccataggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431354 - DNA, 2092 bp, Homo sapiens
ggccggtgctgctggacacagggcacctcccaactccctgccctgtactctgcgcttgcccctgtcccaacaggttccccttctactttgaactgaagatcgccttcgtgatatggctgctgtccccttacaccaagggctccagcgtgctctaccgcaagttcgtgcacccaacgctgtccaacaaggagaaggtttgcccccactctcagctcacctcccagcctgcccccagccaaggcagtccagagcctgcagcctcatacagactggccctccctgtggggcccagagcccaaagtgacctggcagggctgccgtggcctcccggagcaggaaggggcctctgtccaggggtgaacaagggtagggcaggacctcttctcttctcccttcccctccaatcccataggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431355 - DNA, 2624 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcatttaaaacaaaaaaaaaaaaaaaaaaaaaaaaaaaaaaaaaaaaaaaaaaaaaaaaaaaaaaaagggggggccgccgcgaaaaaatattcccccgcggggggcgccccatttcggccccccccctttttttttaacagaggggggcccccatagtggcggcggcggattaactacgcacagcggcgcaggccgccggagttaaaccacaacggcctcgtacgtgggtcggagaacagtcctgcccgcagtgagacctttgtggggagaacggaccgcccctttgtctttgtcgggtgtggcgaccatctttgtgttgaccctactcccccagaagagtgttttaagcgcgccctaagcaggaagaataccaaaatacagcgtgtgatatctgtgtttaccccaccgctcgtttactgtcggccgctaaaaagttttggcacccgcggattgtttttacagagcattatccgggg

SEQ ID NO: 431356 - DNA, 2229 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgggctgatgcggagctgggagggagaggccactgcccttggctgagaggcccagtaaccatgcctgcctccctaggctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431357 - DNA, 2074 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431358 - DNA, 2456 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaaggtgagatgggggcaggctcagactcccagggcccctaccttgtacaaagggccctggccaggcccctttgcatccaccctgtactcggggctgtagagactctgggctcatgcagctggaggctccagtccaggctctactgctatctggccgagtcactttgattgtccggccatttccccatctgtccccagaggcaaagtgtggccctgccccagccctcagctctgtctgtgtgggactgggtgaggacagtgtggggagggcaccgagcctggggctgctgccagcaccatggtgacggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431359 - DNA, 2040 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctatcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431360 - DNA, 1157 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431361 - DNA, 1188 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggcaatgaccccagatattgccccgagggctcactacgctatccaaagctcctgccta

SEQ ID NO: 431362 - DNA, 1349 bp, Homo sapiens
ggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaaggtgagatgggggcaggctcagactcccagggcccctaccttgtacaaagggccctggccaggcccctttgcatccaccctgtactcggggctgtagagactctgggctcatgcagctggaggctccagtccaggctctactgctatctggccgagtcactttgattgtccggccatttccccatctgtccccagaggcaaagtgtggccctgccccagccctcagctctgtctgtgtgggactgggtgaggacagtgtggggagggcaccgagcctggggctgctgccagcaccatggtgacggccagggggtgctgtcagagaagctccgcagcttcagcatgcaggacctgaccctgatccgggacgaggacgcactgcccctgcagaggcctgacggccgcctccgacccagccctggcagcctctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 431363 - DNA, 634 bp, Homo sapiens
  misc_feature (1)..(1): n is a, c, g, or t
ngttggccaggctggtctcaaactaccgacctcaggtgatctgcccgcctcagcctcccaaagtgctgggattaaaggtgtgagccaccatgcccggccgtatcttcccgacaatcttgtgaaatagatactactattaaaagtagctgtatcagataatttctagatgtaagagggttcgccaactatagctagcaagtcaaatcctgctgtttttattttgagaaggggactctgtcccccaagctggagtccagtggcctgaacacggcttctctgtagccttgacttcctaggctcaagcaatcctcctgccccagcctcctacgtagctgggatcacaagatgcgcaccactacgcctggctgtttttgattttttgtagaggtggggatctcacttttttgcccaggctggtctcagactcctgggctcaagtgatcctcctgcctcggcctccacaagtgctgagattactggtgtgagccagcatgcccggcctgccacctgattttgtaccataagcctaaaaatgtttgttgtttgttttttcaatttttagtggtcgaaaaatcaaaataaaatgttttgtaaaataattttataaaatccatttgataaattaataatttgt

SEQ ID NO: 431364 - DNA, 3684 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctct

SEQ ID NO: 431365 - DNA, 1357 bp, Homo sapiens
tcctaatcataggacttttttttttttttttttttttttttttttggagacggagtctcgctgtcgcccaggctggagtgcagtggcgcaatctcggttcactgcaggctccgccccctggggttcacgccattctctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaatt

SEQ ID NO: 431366 - DNA, 1170 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacaattcttgccaactttaactgggcttgaatgtgtgggtgatctgttgtctgattactttctttctgttactgtttctctgtagagattggattcgtagattaaacttgagaaacaaaccataaaagt

SEQ ID NO: 431367 - DNA, 3936 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaaaaaaaaaaaaaaaaaaaaaaaaaaaaaaaaaaaaaaaaaaaaaaaaaaaaacaaaaaaaaacaaaaaaagaccaacggacaggacaactagaacgcaagaaaaacgcaagggagagcagaagaacagagcagcccagccgaagggaggcaccacaccaacacagcggcgagaacacgcgagctacagcgaaccgagtagaggacgaggaagataacaaaacagaaagtagcaaacaacaaaccgctgcgg

SEQ ID NO: 431368 - DNA, 3467 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtccgtatcgatacaggttaaggagaagcttctaattttccaaacattttgatacaacatttttttcaacgactgtattttatagaccttttgtgagaagattagtatagttctatgaaacctaacattcaagtgatcttagtgccggtcaggctaccttgttaaaatgagttagaatccacataattccacgtattgcctctcaagttcaatttagatacccttatattcaaatatataatcctgtactgtaccggctcgatc

SEQ ID NO: 431369 - DNA, 5526 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaatt

SEQ ID NO: 431370 - DNA, 3763 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctcttttaaaaaaaaaaaatatatattttttctatctatttattttatatgatatggctaaatgtattttttgtgggtgtcct

SEQ ID NO: 431371 - DNA, 1570 bp, Homo sapiens
cgcggagcgccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagcacgatgcggccgaacctttaattataaaaaatttatttttcccctccacttaccc

SEQ ID NO: 431372 - DNA, 730 bp, Homo sapiens
gggaggctgaggcaggagaattgcttgaacccaggaggcagaggttgctgtgagtcaagatcacaccactcaggtggatcacctgaggtcaggagttcaagaccagcctggctaacatggtgaaaccccgtctctactaaaaatacaaaaattagtcacgtgtggtggtggacgcctgtaatcccagctacttgggaggctgaggcagaagaattgcttgaacccaggaggcagaggttgcagtgagctgagattgagccactgcactccagcctgggcgacagggcgagactccatctcaaagaaaaaaaaaaaagaaaaagaaactgaaaagtctattcctccacctacttttttttctctgtatcaactatgattactctcataaaaacctaagtggtattatattaagcatctggttttatagattgcctttctcagttaaaaatgttggatggccgggcgcggtggctcacgcctgtaatcccagcactttgggaggctgaggtgggcagatcacgaggtcaggagatcgcgaccatcctggctaacacggtgaaaccccgtctctactaaaaaatagaaaaaattagccgggtgtggtggcaggcgcctgtagtcccagctactcgggaggctgaggcaggagaatggtgtaaaacctgggaggtggagcttgcagtgagccaagatcgtgccactgggcgacagagcgagactcggtctcaaa

SEQ ID NO: 431373 - DNA, 713 bp, Homo sapiens
gggaggctgaggcaggagaattgcttgaacccaggaggcagaggttgctgtgagtcaagatcacaccactcaggtggatcacctgaggtcaggagttcaagaccagcctggctaacatggtgaaaccccgtctctactaaaaatacaaaaattagtcacgtgtggtggtggacgcctgtaatcccagctactcaggaggctgacgcaggagaatcgcttgaacctgggaggcagaggttgctgtgagctgagattgtgccattgcactccagcctgggcaacaagaacaaaacttcatctcaaaaaaaaagatcacgctgctgcactccagcctggctgatagaacgaaactccgtctcaaagaaaaacgaaaaagtaatactagtacatgtttactgtagaagtacatataatataaaaacatagaaaaagaaagtggctgggtgcggtggttcacgcctgtaatcccagcagtttgggaggccgaggtgggtggatcatgtgaggccgggagttcgagaccagcctggccaacatggtgatttcccgttggatatctactaaaaataccagaaaattagccgggcttggtggcatgcgtctgtaatcctagctacttgcgaggctgatgcaggagaatcgcttgaacccaagaggcagaggttgcaatgagccgagatcgcgccaccgcactccagcctgggcaatagagt

SEQ ID NO: 431374 - DNA, 2399 bp, Homo sapiens
gagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctcttagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaaattt

SEQ ID NO: 431375 - DNA, 1900 bp, Homo sapiens
gagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctcttagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttaatttgttagtgtaaataaatttcttgccaatgagtattattgttgttagacaacgaatgcaataaaaagaaatactgaggtctgttgaagcaaattt

SEQ ID NO: 431376 - DNA, 630 bp, Homo sapiens
gccaggcgactgcaacagtctcctcactcctcccacacagagtctcggcctttcctcccgcgtggacggcgcctctcccccgccatcctttccctggctgatgctgcatctgcaacgctcagcttctccctggaacctgctcccacagcatgtggcccggccctgtgcctgccctgagccctggttgtagagctgacatttgactctggctgccttgagggcagggaccgtggcttaaccagccactctgggcttcactttcctcatttgtcaagtggatctgccccaaagtttgctttgaggaaacgggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagagtgagatcccatttccacaaaaaataaaaaagattatccacgcatggtggcatgcacctg

SEQ ID NO: 431377 - DNA, 1805 bp, Homo sapiens
gacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaagtgt

SEQ ID NO: 431378 - DNA, 531 bp, Homo sapiens
gcagaagggtgcagtggaaggggtgggggtagtgagataggttgcctcttactcaagctggaaggggatttcctgaggacagacaccaagcaatttaaaaactggcctggagagagggaagaggaaacagacctcgtgggtgtttctctgggtcaggcacttggcttctcagtcttgactttgattattcttttgtttttttgagacagggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagagtgagatcccatttccacaaaaaataaaaaagattatccacgcatggtggcatgcacctg

SEQ ID NO: 431379 - DNA, 777 bp, Homo sapiens
tccccgctcgcgactccccaccccccagggctccctaaagagggccacgagctgcgaaagggcgggaaaggcagttggagaagagaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtgggaagcactgcttgcagtctac

SEQ ID NO: 431380 - DNA, 2318 bp, Homo sapiens
tccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaagtgt

SEQ ID NO: 431381 - DNA, 2353 bp, Homo sapiens
tccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaaaaagtgt

SEQ ID NO: 431382 - DNA, 620 bp, Homo sapiens
tccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgggcctccctctttccatttccagcttttagagctgcttctgccttccttggctcctggctttctcacatcttcagattccaaagcgcatcactccagtctgctcgtgtcaccacaagctttcttcccttctccagtcagtcaaatccgtcttctaaggatactgctgatcatctttagggctcacgcctgtagtcctggcactttgagaggacaaagagggaggatcgcttgagcccaggagttgaagaccagggcaacagagtgagatcccatttccacaaaaaataaaaaagattatccacgcatggtggcatgcacctg

SEQ ID NO: 431383 - DNA, 517 bp, Homo sapiens
cgggtgatggctccatcgtaatttcagtttccctttccaggaagaaaatacacagatgtgcttccttcccagtcctgacaaatggcctttccttaagttcctcattaattcatatgaagacaacacatttggtgactaaatttggaatcagaggcttttaaaggtgaatctcagctcttactgctttgctttcccctgtttagggataagagtggcaaatgggggctgggtgtggtggctcatgcctgtaatcccgacattttggggaggccaaggggagtagattacttggggtctggagtttgagaccagcctgggcaacatggcgaaacctcgtctctacaaaaatacaaaaattagcctggcgtagtggctcctgcctgtagtttcagatacttggaggctgaggtgggaggatcacatgaacctgggaggcagacattgcagtgagccgagatcgtaccactgcactccagcctgggtaacaaaagtgagaccctgtctcaaaaaaaaaaaa

SEQ ID NO: 431384 - DNA, 1022 bp, Homo sapiens
aggtgcctgtgatcccagctacttgggaggtggagcttgcagtgagccaagatctcgccagtgtatgccagcctgggcaacagtgtgagacttggtctcaaaacaaacaaacaaacaaaaaaacctaagtcccttcgctgtcaaatccttaggggagtaaattctgtcatctctgggtacctgttttcctgacttttcaaggtgttgaaaagagccttatgattcagccaaactttccaacagctctgatgggcagtttatcctcactcccactctacccagctctgttcctttcttctcttccactgtgtctgaatttgacagggtcccagtctcagtggtactgttcaaagtgtttataatgttactcttctgggcaatttttgcttcatacgtctccatccaatcaatgcatttcaggtgttgtggcagagagatttttgggggtgctggtacaagcaagacaggaataacccttaagtcacaataaaggcctctgcagggagtttttacattcacttcattttagacatcctcatttccctttcctacatcatgtaatttgtgtgattttttttttttagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaattgcagtgtcctaagttttttaaattcctcttactatcattcccaa

SEQ ID NO: 431385 - DNA, 976 bp, Homo sapiens
aggtgcctgtgatcccagctacttgggaggtggagcttgcagtgagccaagatctcgccagtgtatgccagcctgggcaacagtgtgagacttggtctcaaaacaaacaaacaaacaaaaaaacctaagtcccttcgctgtcaaatccttaggggagtaaattctgtcatctctgggtacctgttttcctgacttttcaaggtgttgaaaagagccttatgattcagccaaactttccaacagctctgatgggcagtttatcctcactcccactctacccagctctgttcctttcttctcttccactgtgtctgaatttgacagggtcccagtctcagtggtactgttcaaagtgtttataatgttactcttctgggcaatttttgcttcatacgtctccatccaatcaatgcatttcaggtgttgtggcagagagatttttgggggtgctggtacaagcaagacaggaataacccttaagtcacaataaaggcctctgcagggagtttttacattcacttcattttagacatcctcatttccctttcctacatcatgtaatttgtgtgattttttttttttagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431386 - DNA, 1822 bp, Homo sapiens
tcgggggcggggctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431387 - DNA, 1593 bp, Homo sapiens
ggccgcgcccacgggccggctcagcggcggtggcggcaggtggggaagcgcgtctgagccctccatttcccggttctaaccgcgcagcagggcccaaccgggaccttgagtgcggcgaggcgtggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431388 - DNA, 2138 bp, Homo sapiens
tcgggggcggggctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaaaaaaaaaaaaaaaaaaaaaaaaaaaaaaaaaaaaaggggggggggggaaaaagtacccccgggggggccaaagtttacgctgacacccgggtttctcttggcaccaagggggcgcccaataaagggagggcggaataaataaggaaagagagagagggcgggagggtaaacacaaccggcgcggagcggggaacacctcggcgcgtcgggacctggggaagggaccctactccggcgggggcgcaatatttcggagcacacccacaggagataacggccaagggaaacaataactatcccgcgtgcggggaccccc

SEQ ID NO: 431389 - DNA, 1681 bp, Homo sapiens
tcgggggcggggctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431390 - DNA, 443 bp, Homo sapiens
  misc_feature (54)..(54): n is a, c, g, or t
tataaagaagagtggcgtttgtacaatccaaggaaagacaagccacgcgctgantaggcacgtcatatgaaagttgagtggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431391 - DNA, 437 bp, Homo sapiens
aagagtagtagacccgtaattgtgccctcacaaaccaagcggacctgagtaggcacttctctgcaaattgagtggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431392 - DNA, 1729 bp, Homo sapiens
tcgggggcggggctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaa

SEQ ID NO: 431393 - DNA, 1868 bp, Homo sapiens
tcgggggcggggctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatactttaaattgcagtgtcctaagttttttaaattcctcttactatcattcccaa

SEQ ID NO: 431394 - DNA, 627 bp, Homo sapiens
ccctgagtagctgggactataggactataggcacacaccaccactcttggctaatttttttgtttgtttgagacgaagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaata

SEQ ID NO: 431395 - DNA, 443 bp, Homo sapiens
agagtcacgggcaggaggcagagagagccacctgtgctgcaaaagactcaagattagcagctgctgaagaggcatctgtggagtctctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431396 - DNA, 545 bp, Homo sapiens
  misc_feature (19)..(19): n is a, c, g, or t
  misc_feature (37)..(38): n is a, c, g, or t
  misc_feature (40)..(40): n is a, c, g, or t
  misc_feature (72)..(72): n is a, c, g, or t
  misc_feature (75)..(75): n is a, c, g, or t
  misc_feature (105)..(105): n is a, c, g, or t
  misc_feature (119)..(119): n is a, c, g, or t
  misc_feature (149)..(149): n is a, c, g, or t
  misc_feature (203)..(203): n is a, c, g, or t
  misc_feature (205)..(205): n is a, c, g, or t
  misc_feature (218)..(218): n is a, c, g, or t
  misc_feature (246)..(246): n is a, c, g, or t
  misc_feature (253)..(253): n is a, c, g, or t
  misc_feature (261)..(261): n is a, c, g, or t
tgccagcaacgccttcacnaccaccactcctttttgnnanaaccaccaccccctcaggccccctccccgccntcnctcgcgcgccatgcacctaccctctcgccncccccgccatgtgnttgaaagccccccccactcttggggccccnattgttgcccctgcacgtcccctcgcctgccctcgcgtcgcgtcctcccgtggncnttgatacgccccntcacaaagagagcggaaggaggctgtcnttcctcnttgtaggnagcccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431397 - DNA, 619 bp, Homo sapiens
ccctgaattcctgccaagtcgactcttgaggagtcccccaagttggggtcctagattgcatgtcatcctgcttaccaggcgtcacaaggccatgctgggggcatgaggaggttggggcagcaggagagtggggagaaactaggagagtgcctgagtattttagaaagaaccaagttatgctgggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttgatgtgtgagctgtgtctgtgtgttatgtgcataagcggtggtgtgacatacacacatgtgtactgtcccttatgccctggcctgagctctccagctgccttctcagcctgaaggctgggcttctctgctggcttggggtcctagattgcatgtcacctgcttaccaggcgtcacaaggcca

SEQ ID NO: 431398 - DNA, 384 bp, Homo sapiens
gctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattctccccgggatacctgtatcccggggagggacctcacaacagccagactgtttctcctgctcacttaaccctgtgttgccccacacagtatcgtgaagagcgcttccgactgtccagttgtgaggcaccaccggggtcatcagggattggtggagagggagtataaagaccagggttggtaagggagggcccagaccgaagaaggtttggtga

SEQ ID NO: 431399 - DNA, 4888 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431400 - DNA, 3656 bp, Homo sapiens
aaggctcccctctgtaagcctgggaagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431401 - DNA, 3539 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431402 - DNA, 2486 bp, Homo sapiens
actctacagatcccttttctttgggacggcgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431403 - DNA, 5187 bp, Homo sapiens
  misc_feature (4905)..(4905): n is a, c, g, or t
  misc_feature (4907)..(4907): n is a, c, g, or t
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaaaaagacgaananacagacggagacaaaacacagaacaccaaacacagcggggagcaaacaagaaccccgggaggcaacaaatacagacacaacattatacaaaaagggcgcacccaaggagcgagaacaacaataacggagccgcgcacagaacaaacgcgcgaagagaacaagagaacaggcgagaccagggagcgacccaacggcggggcacacaagggaacaaaccaacaagaacgaccggccaacaccggggcccgcggccccaacgcggagacaccacgaccaaacc

SEQ ID NO: 431404 - DNA, 5448 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccagtttgtgcctccagcatatgaaaaggactatttgaatccccaaaacatcaggagtcgggaaacttcggaagacagctgtgcctggctctgtggctgcatgcagtgcttcacttggccagcagaggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttgatgtgtgagctgtgtctgtgtgttatgtgcataagcggtggtgtgacatacacacatgtgtactgtcccttatgccctggcctgagctctccagctgccttctcagcctgaaggctgggcttctctgctggcttggggtcctagattgcatgtcacctgcttaccaggcgtcacaaggcca

SEQ ID NO: 431405 - DNA, 5054 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccaaaaaaaagaacaaacacggccggggagagaaagcaagaacaacgacacaccagagcagaggaagcgcgggtcggcgcacagcgggagggggaagcgaacagggagaggacgccgcaacggcgaccatgcggcaggcgcaaccagcggaagtaacgaagcggggcgc

SEQ ID NO: 431406 - DNA, 4748 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431407 - DNA, 4590 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaagacttccaccatgtgtctgctgtgctcaactttgatcttcccccaacccctgaggcctacatccatcgagctggcaggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 431408 - DNA, 4429 bp, Homo sapiens
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcagtagtgtgacggcccaggcatctgcatggtaggcacactgagggacttggggtgtgctggacagagcctgcgggttggagatgcaagctgcactgtcttcccttgcaggacagcacgcgctaacaacccaggcatagtcttaacctttgtgcttcccacggagcagttccacttaggcaagattgaggagcttctcagtggaggtaagagcctggctcttgtggtcctgggccagggtcaggcttcttccacaatgcttt

SEQ ID NO: 431409 - DNA, 2283 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcctttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 431410 - DNA, 2507 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcctttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaattcttctccttttgttatttcttatgtcctataccatatatgtacctatttatatatatatttatgtatttttaaaatttttatttattttattttttgagacagtcttgctctgtcgcccaggctggagtgcagtggcatgatcttggctcactgcaacctctgcctcccgggttcaagcagttctgcctcaacttctgagtagctgggattacagacaccca

SEQ ID NO: 431411 - DNA, 1828 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcatttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 431412 - DNA, 1867 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcctttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaata

SEQ ID NO: 431413 - DNA, 2320 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcctttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaataaaaaaaaaaaaaaacaaaaaaaaaacaaaaaaaaaacaaaaaaaaaaaacaaaaaaaaaaaaaaaaaaacaaaacaaaaaacgacgggcggcgccccccccaaaaaaccccccgggggagccccaaccaccaccactctttttaacaaggggccccccacaagggcaacaaaaaacggcgggcgcgccaaacacgggcagaggacaaacacaacgcgtctcgagagctattcggcggaagaacaccacccttcggggcgccggcggaccatggggggcacaaccaccccgccagaatatgggggccgagggaaacaacaccgcgggttactgggggcaacacccgcgtatcgtcggcgcaaattctctcgttttttcttatacgcggcgtacaaacgacaaaagccagcacgccgcgcgcaacaaggacggaccacacacacacgcagacggc

SEQ ID NO: 431414 - DNA, 1543 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaatcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaata

SEQ ID NO: 431415 - DNA, 1899 bp, Homo sapiens
gtccctttcttggggcagcctcagtggggagaccatagcactcctaatggagtcacagatagtattccaaaaggagtttggtcctggagttgagtaattacacgcagggagggacctcacaacagccagactgtttctcctgctcacttaaccctgtgttgccccacacagtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcctttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 431416 - DNA, 1412 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcatttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaata

SEQ ID NO: 431417 - DNA, 3667 bp, Homo sapiens
  misc_feature (3596)..(3596): n is a, c, g, or t
  misc_feature (3605)..(3605): n is a, c, g, or t
  misc_feature (3667)..(3667): n is a, c, g, or t
gtgagccatgatcgtgccactgcactccagtctgggcaacagtgatcccatctgaaaaaaaaaaacaaaaaaaaaaatgcaatttagggccaggtggggtggctcacgcctataatcccagcactttgggaggccagggcagggggatcgcctgaggtcagcagtttgagaccaggctggccaacatggtgaaaacccctctctactaaaagtataaaaattagccgggcatggtggtgtgtgcctgtagtcccagctattcgggaagctgaggcaggagaatcgcttgaacccgggaggaggttgcagtgagcagaaatcgagccactgcactccagcctggggggcagagggagactctgtctcagaaaaaaaaaaaaaatgcaatttagttctctaggcttttccatttaatagttttatatcctcctgtttctaaatctggatgacagtgtaacactccagtaaggtgaattgtgaattgctgaaattcttcagatgtttaaaagagttttcagtattcctcatgttagaattaatgcagagaaaaattatatcctttgaactagttacatgttgtggacttctggcctgaggctcttggggattatgtgacatattgggaagggacacatttctgctctgtggctgttactagaaatctagccagcaaatcagactacgtttgtgagaagacaggaaggcacagattagggttgagccagccttcaacaggtttggctggcagtagacacagtggagcacatcttaactattttggtaggtcctgggtttctcttggtagtttttgatagaaaggggaatggtgtgaggaaaaagtgggcatacatttcacctttccactgataaggcaggtggaattgggatagtcagtggatgggccaatagctggtggctgtgagaagaataaggatttccatactggtgtgtcatatttacagataggttgtgacctaaaaagttttttaaaaaacagcagttagggcctgggcgcggtggctcacgcctgtaatcccagcactttgggaggccgaggcgggcggatcacaaggtcaggagatcgagaccatcctggctaacaacggtgaaaccctgtctctactaaaaatacaaaaaattggccgggcgtggtggcgggtgcctgtagtcccagctactcgggaggctgaggcaagagaatggcgtgaactcgggaggtggagcttgcagtgagctgagatcatgccactgcactccagcctgggcgacagagtgagactccttctaaaaaacaaaaacaaaaccaaaacagtagttagggtacacacacacaaattctagtgattttccccccaatactacccttgacttttgaaattcttgctttctcagagtttacaacatccttaccaaacagccttctccctccttaccacaaaaaaagaaaaaaaagttctggggttgaggggacactccattcttaacatcctctattatcccagcccaattccccagctctcactgggactagttgtacctatcttcatcatttggtcccagcatgactacctgttggtgcatgagctgatctctcctaacctaacagccagatgctagtctctggtactcagatgctgggctgcatcagataggatgcacaggatcatcctggaagcttgttgacatagattcctgtgcaacactcagatatagtcttaatgtagatttgtgttgggtggtatggtaggtagaataatggcctaccactctgaaacatatgaatatgttacctaacatgacagaagagaattaagttgctaatcagatgactgtaaaataaattatcctggatcatctggatgggcctaatgtaatcacaaaggttgtttccttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttgagacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggcgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgactcttttcttgcttgagagactcagagttctctgtgactgcccngatttacangctttctctgtgagtatttacgagagtaacctcaggtgtatatacgtacttagtaaggtcan

SEQ ID NO: 431418 - DNA, 1049 bp, Homo sapiens
  misc_feature (792)..(792): n is a, c, g, or t
  misc_feature (794)..(794): n is a, c, g, or t
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggattttgaacacnantgacacacggaagtaaacgtccaaacaagagcgacaaaaacaacgcctccgagagggcatcacaatacccggcggcgcgcagcaacggaggcacacgacacgggcgccccggggccacaaagccgagataccgggaccacagcagtacttgcgacccaggggggagacaactgcgcgagccccctaaaagcggcgggcagcactaaagatccgagagaacggcccggggacgccggcattatgcaggcgagcgaa

SEQ ID NO: 431419 - DNA, 1758 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaagggcaagtgcatatctccttgtaatttgagagggcagttgacctttatacccactatacctactcaagtttctgcttgggagatcagctctgcagagaatggaatgagaagtattggtttagataggttgttgtcgttgttttgagacggagtttcactcttgttgcccatgctggagtgcaatgccatgatcttggctcactgcaacctccgcctccccaggttcaagcgattctcctgcctcagcctcctgagtagctgggattacaggcatgcgccaccatgcctggctaattttgtacttttagtagagacgggggtttctccacgttggtcaggctggtctcgaactcccgacatcaagtgatccgcccgcctcagcctcccaaagtgctgggattacaggtgtgagctaccgcgccctgcctgttttgcttttttatcaaaacattttattgtggtaaaatataacaccaaatgtgtcattttaactgtctatatagttcagtggtattaagtgccttcataatgttgtgctaccaacaccatcatccagctccagaactttttcatcttctcaaactaaaaatctgtacttattttgttttgtttttgagatggagtctcgctctgttgcccaggctggagcgcagtggcgccatctcggctcactgcaccctccgcctcccaggttcaagcgattctcctgcctcagcctcccaagtagctgggattacaggcaagtgccaccatgcgtggctcatttttgtgtttttagtagagactgggtttcaccatgttggccaggctggtcttgaactcctggcctcaggcaatccactgccgcagcctcccaaagtgttgggattacaggcgtgagccactgcacccagcaaatctgtacttattataaacaataacttcccgtttccttttgtcctgacacccaccattctactttctgtctctatgatcctgactaccctatctcatataagtggaatcattcagtatttgtccttttgtgactggcttatttcactgagtataatgttctcacagttcatccatgttatagcatgtgtcagaatttcttaaggctaatattccattgtatgcatgtgccacatttcgctttcagtagtcatttttaagctctataaaataaaatgaagaaaggacagttcacaatctaataatagcca

SEQ ID NO: 431420 - DNA, 975 bp, Homo sapiens
accgactgctatgtaactacaactcacacttatataatctcatctgtcgtggtgtgttcaacttcctcctgctctccgtggcctggtacgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccagtttgtgcctccagcatatgaaaaggactatttgaatccccaaaacatcaggagtcgggaaacttcggaagacagctgtgcctggctctgtggctgcatgcagtgcttcacttggccagcagaggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttgatgtgtgagctgtgtctgtgtgttatgtgcataagcggtggtgtgacatacacacatgtgtactgtcccttatgccctggcctgagctctccagctgccttctcagcctgaaggctgggcttctctgctggcttggggtcctagattgcatgtcacctgcttaccaggcgtcacaaggcca

SEQ ID NO: 431421 - DNA, 1797 bp, Homo sapiens
  misc_feature (1743)..(1744): n is a, c, g, or t
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaagggcaagtgcatatctccttgtaatttgagagggcagttgacctttatacccactatacctactcaagtttctgcttgggagatcagctctgcagagaatggaatgagaagtattggtttagataggttgttgtcgttgttttgagacggagtttcactcttgttgcccatgctggagtgcaatgccatgatcttggctcactgcaacctccgcctccccaggttcaagcgattctcctgcctcagcctcctgagtagctgggattacaggcatgcgccaccatgcctggctaattttgtacttttagtagagacgggggtttctccacgttggtcaggctggtctcgaactcccgacatcaagtgatccgcccgcctcagcctcccaaagtgctgggattacaggtgtgagctaccgcgccctgcctgttttgcttttttatcaaaacattttattgtggtaaaatataacaccaaatgtgtcattttaactgtctatatagttcagtggtattaagtgccttcataatgttgtgctaccaacaccatcatccagctccagaactttttcatcttctcaaactaaaaatctgtacttattttgttttgtttttgagatggagtctcgctctgttgcccaggctggagcgcagtggcgccatctcggctcactgcaccctccgcctcccaggttcaagcgattctcctgcctcagcctcccaagtagctgggattacaggcaagtgccaccatgcgtggctcatttttgtgtttttagtagagactgggtttcaccatgttggccaggctggtcttgaactcctggcctcaggcaatccactgccgcagcctcccaaagtgttgggattacaggcgtgagccactgcacccagcaaatctgtacttattataaacaataacttcccgtttccttttgtcctgacacccaccattctactttctgtctctatgattccacttacatgagataactagaataggcaaattcatagagacagaaagtagaatggtgatttcctgaggctgaggggcagaggagatggacagttagtgtttaagcagtatcatcttcttcaaacttaaaaatctgtacttattttgttttgtttttgaggatgggagtcttcgctctgttgccccactggcactccaccccggggcaacaggannggggactcccatcttcaagaaaaaaaaaatttaaacttctgtggcatccaagg

SEQ ID NO: 431422 - DNA, 792 bp, Homo sapiens
gcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactcacacacaaccttatacacacagttaatacacacataatatgtgggcgctgccagccaacctccaagacacataatatgcacacacatgctcacactctcacacacccttatgcagacacacattacatacacacacatatgtacgcacggcctactgcttg

SEQ ID NO: 431423 - DNA, 186 bp, Homo sapiens
cagcagatgggtcaggtaggctggaaggggtagagacacgtggacacagtgatgtgcactgctggctaaagtctttaattcatattcttacagacaggtccggtggtagaacaggcagtgagaggccttgttcttgttcctaccaaggagctggcacggcaagcacagtccatgattcagcagctg

SEQ ID NO: 431424 - DNA, 470 bp, Homo sapiens
ggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggtcaggcgggctgagggtggggaggccctttgtacccagctcagccctcggcggcgctccctcctcccgagcccagccgggtcgctggctcccccagtacctagcctgagggtgccccgaggacgccaggccccctgcctagagctccgggccgcacgtcggagggggccgggcggagaggcggcccactagggccggtcgtgactatgtgtctgccccgcaggcaactatcgtacccagatgtgggataagcagaaggaggtcttcctgccctcgacccctggcctgggcatgcacgtggaagtgaaggaccccgacggcaag

SEQ ID NO: 431425 - DNA, 681 bp, Homo sapiens
gcaactatcgtacccagatgtgggataagcagaaggaggtcttcctgccctcgacccctggcctgggcatgcacgtggaagtgaaggaccccgacggcaaggtaaggctggcgttggcccacgcagccgttcttcagtggagctcccgtggggtgtaaagcactgcctggaggaggcctcaagggacaggaacttgcacttggagagcctgcggtataaaggtggggccttcactcacatatgttgcaggtggtgctgtcccggcagtacggctcggagggccgcttcacgttcacctcccacacgcccggtgaccatcaaatctgtctgcactccaattctaccaggatggctctcttcgctggtggcaaactggtaagaggattttctctttggcttcagcttagaatctctcacttgtttccaaattttgatttatcaagattgtgaaactttgtagcacagtcagaattggggagacagatgttgccttctgctccacagccagggacaatagtgggttccataccctggaacagacaactggaggccccaccactcatacattccatgtttccttgtagcgtgtgcatctcgacatccaggttggggagcatgccaacaactaccctgagattgctgcaaaagataagctgacggagctacagctccgcgcccgcc

SEQ ID NO: 431426 - DNA, 4173 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacaggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431427 - DNA, 4278 bp, Homo sapiens
  misc_feature (2214)..(2214): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaagtgcggagcttgttaacagacgtgcatgcctggcctgtggactgtgcagtaagtgttgaaaaaggcactcttccctgacttgatttctttctgcatctcctcccaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacaggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431428 - DNA, 4312 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431429 - DNA, 4506 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagctgagcctgctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431430 - DNA, 4595 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagcaaccctgcgaagaaggaattgtgatactcatgcttaggatctcatgggaaaggcaacaacaagcagtcacaggggctcggagctggagagtgacacactcagctttgccacatggtgctgatggacatcagacggagacttccagcaatctgttggttttgcaagtctgaagctccgggcagagctgagcctggtatccaatgtgcaatcccagtgcatgggaggccagggggctgccctgcccccctcagcctgggaagtaatgaccctttgctccctcagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431431 - DNA, 4372 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggaggaatttttggtgtggcagaggacacagaggacaccccagttataacagggggtgataccactcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431432 - DNA, 4197 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431433 - DNA, 3511 bp, Homo sapiens
  misc_feature (2109)..(2109): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggaggtaccaacgggggcagcgggtacacagcgggagctcctcccgggcctcggttcacgtcactggtcatttctcctatgtaaacagtactttatagtttacaaagccttcccatgggcatgacttctcttgactatgatgatcttgttggtctccctccctcccctccctgtctctccaccctttactccattccactcttaaccagactcccctagtgcccagggaaccaccaacctttgctgggcacctctgtgtgtcaggcacgagacatataaatgtgaatttgactct

SEQ ID NO: 431434 - DNA, 3246 bp, Homo sapiens
  misc_feature (1043)..(1043): n is a, c, g, or t
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggagcctttgatgaagtgacctcatgcctggtgaaggtgccagagaagacagaaggtggcaacaacatggctctggacagtcaggcccaacccaggtctgggccatgtggcaggctcaggaggcccaagaagaccagtccagcaggtgaggcacacttgcatctgcaggacttggagatggccagtggggaagactagacaaaccggtggacgtgagtgcgacacagggagtgtggacaaggctgcttgatggacacaatgtggaggaggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431435 - DNA, 2498 bp, Homo sapiens
  misc_feature (295)..(295): n is a, c, g, or t
ggcttggtcctcctcccatccacaggctctttaccatcagaccctggaggccctgcagacactgctcaaagccctctttatcgaggaccccactcctgctgggctgaagagcatcttggaggccctggggccttggatgaactctgggaaggcccatgagcgagcacgggctgtgaacaccaatgtctctgtgttgaaccacatgcttctaactctgcctttctttattgcaatacaaacagatgcccttggggttcccggcgctggggcttctgctggggagactcatccttcncattggggatcctgatgaggagattggctgtgaggctctggacggcatcatcatcctctacactattctggagctccaaaaacgagccagagataaggaagagaccaacaaaaaggagctatatgagagcaacaagcatttcctggggccctacaaccctgtgagcccgtgccagaacattctgcgggtgatcgaggaatttggagacttcctggggccccagcagataaaggacctgctgctggccgccctggaagggctgaaaggcagctcagaggctccagggaaggactccagggagatgatgcagctggcctcggaggtcatgctcagctcggtgctggagtggtaccgccacagggcgctggaggtgatcccagaaatcatgcaaggcatctacatgcagctgagccacatccaggagcctcgggcccgccaggtggccctgctgcccgtctccctcctggctagctccttcatgaccgaggttgtggtggccctgctcatgtgccccctcccactgaacagcaatggagcagagatgtggaggcagctgatactgtgtaagcccagctgtgatgtccgagacctcctggatctgctcctgggcagcctgaaggagaagcccgtcaccaaggagggccgggcttccatcgtgcccctggcggcagccagcggcctgtgcgagctcctgtccgtcaacagctgcatgggccgtgtgaggcgcatctaccctcagctgctcctggccctgctcattcaggtccattaccacatcggcctcaacctgcctggctgcgtggctcctcccaaggacaccaagaagggtgcacagccctctcccttcgtacctgtgcgctgggtggtgaaagtggtgaaaaccctgctactgaggatgggctgctcttatgagaccacgtttctggaggaccagggtggctgggagctcatggagcaggtggagagccaccaccgcggagtggccttgctggcaagggccatggtgcagtactcctgccaggagctgtgccgcatcctctacctgctcatcccgctcctggagcgaggcgacgagaagcacaggatcacggccaccgccttcttcgtggagctcctccagatggagcaggtgcgccggatccccgaggaatactctctggggcggatggcagaaggcctgagccaccacgaccccatcatgaaggtgctgtccattcgaggcctggtcatcctggcccgcaggtctgagaagaccgccaaggtgaaggccctcctgccctccatggtgaagggcctgaagaacatggatgggatgctggtggtggaagcggtccacaacctcaaggctgtcttcaaggggcgggaccagaagctgatggacagtgcggtctatgtggagatgctgcagatcctgctgccgcacttcagcgacgcacgagaggacgtgcgctcctcctgcatcaacctgtatgggaaggtggtccagaagcttcgggcaccacgcactcaggccatggaggagcagctggtcagcaccttggtgcccctactgctgaccatgcaggagggcaactccaaggtaagccagaagtgtgtgaagaccctgttacgctgttcttacttcatggcttgggagttgccaaaaagagcttatagccggaagccctgggacaaccaacagcagacagtggccaaaatttgcaagtgccttgtgaacacccaccgagacagcgccttcatattcctcagccagagcctggagtatgccaagaactcacgggcctccctccggaagtgctcagtcatgttcatagggtccctggtcccctgcatggagagcataatgacagaagatcgtctgaatgaagtgaaagctgctctggataacttgagacatgacccagaagcatcagtgtgcatctacgcagcccaggtccaggaccacatcctggccagctgctggcagaactcctggctgccgcacgggaactcatgggtgtgttactcagccaccacccaccgctggagccccagctgtgagaacctgcccacttcccaccagcggcgctcctggatcatgcaggcactgggctcctggaagatgtccttgaagaagtgacgtccctgagccccaaaccctcctcagggtggttgagttccagccatgctccctataaatgtcatgtggcttacctctccatct

SEQ ID NO: 431436 - DNA, 1643 bp, Homo sapiens
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgaggatggagtctcactctgttgcccaggctggagtgtaatggcacaatctcggctcactgcaacctccaccttcggggttcaagcaattctcctg

SEQ ID NO: 431437 - DNA, 2125 bp, Homo sapiens
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgaggcagatccaggaggagccactggattctctctcaagctccgtccgcaagcaggccatggagatcctgacccagctgagccacacccagcccaccctgggcatgcgggagaggtcggagctggtgaacgtgtgtgcgcacagcgtgttctccctgccctccgtgcaggcgatgcaggagaaggacgaggccaaggctgagaccatccaggctctttaccatcagaccctggaggccctgcagacactgctcaaagccctctttatcgaggaccccactcctgctgggctgaagagcatcttggaggggcccgctcctgcttaaaaacaccatgcatgcagactgctgctgggaatgtgacagttggctgttggagagaagggggcactggcattgagagactccagactggacat

SEQ ID NO: 431438 - DNA, 2142 bp, Homo sapiens
ggcctgggctggggaagcctaggtaagctgaggggcagctctgggaaagtcctaggggtgggggcagtctccacagcctccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctgaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagcgatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggagcctttgatgaagtgacctcatgcctggtgaaggtgccagagaagacagaaggtggcaacaacatggctctggttgagaatgtcaccacccttcagaagagccaggatctgctggaggcagaaggagaaaagaagaccatgataaagaagattatgccacacccagcccaccctgggcatgcgggagaggtcggagctggtgaacgtgtgtgcgcacagcgtgttctccctgccctccgtgcaggcgatgcaggagaaggacgaggccaaggctgagaccatccaggtgaggcgggaccttcccagcagggcctcagggctggcccatgttctgggaggagatatggagctgcatcctccggctcattggtctgtggccttgggcaattcaactgacttctgttggtctgagtaggtacttgataaatggtgaagggatgaatcattcaaataaagacacccagctgggcgcggtggctcacacctgtaatcccagcactttgggaggctgagccgggtggatcacgaggtcaggagactgagaccatcctggctaacacggtgaatccccgtctctactgaaaatata

SEQ ID NO: 431439 - DNA, 619 bp, Homo sapiens
gggcccgctcctgcttaaaaacaccatgcatgcaggtgagctgtccctatgattcccacagggagggtagccccagattgagggtaggggtgctgggaggactggggagttcatccagcagttagattgctgtgttaaggcaggtgtttgacagctgccctatggtctcctccacagagcccacttcacccggaacaagcaaactgttaaggctataggcagctttgccagggttgctgtgagaatctagtgccatgagtactggcagagtagttctagcaacttaggagtttgtctctggtttagagcaccccaatcttgcaaggctcagggctccttgttggtgcacttaggttaccctgtcacatgtggccagctggaagtggggtaactcataaggaggctcttccttccctttttctgccttaaagtagaagagactcctcatttgtctatttgtaagcttccaactgtgtaactggcactgggctaggagctggggttgccccaggggccaaggtatacacagttcttgtcattgcaaagctcatctctagcaagagctagaacactaaatgaattcactggaatgaaatgtgctgagtattttgctagaagt

SEQ ID NO: 431440 - DNA, 2089 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttctttcttatcagcaccataaagtccagaagacagtagaaaagtatcttcaaagtgctgaggaaaataagtatcaacttagaattttatgtacaatattggaggcaaaataaagacatgtttagacatacaaaactaagagagttgaattattaaaggttatattccaaggacaaaaaagaggatctgcccaaggtgaaggtatggcatacaagaaacaatggtcaacagagaaataaaatatatggatga

SEQ ID NO: 431441 - DNA, 1324 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgta

SEQ ID NO: 431442 - DNA, 1317 bp, Homo sapiens
agcacagaggaggtggacagctggacagcatcagatggaggacagcacagaggggacagcacagaggatggagcacagaggaggtggacagcacagaggaggtggacaccacagaggaggtggacagcacagaggaggtggacagcacaggttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431443 - DNA, 1491 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaagcacaccacgccaacaacccccgcggcctcctctctcggctgcgcaaagccgctcatgcactgcccctggccatgctgctccctggcccagtctcctgtccagggaggattcccggccccatataggggccgttcattcacaccagtacgactcctccccgcgccaccctcccccgcccccccccccgcccccccccccccctccgccccctccccctccccccacgctttccctcccccctcctctcctcctccgcctccc

SEQ ID NO: 431444 - DNA, 1512 bp, Homo sapiens
attctcataatcgcccacgagcttacatcctcattactattctgcctagcaaactccaactacgaaagcggcatcttcccgatgaagatgccgttttcggggcggtgatgtagagggtgatggtagatgtggcgggttttaggggctctttggtgaagagttttatggcgtcagcgtagggttgtagtagcccataggggcctacaacgttggggcctttgcgtagttgtatatagcctagaatttttcgttcggtaagcattaggaatgccattgcgattagaatgggtacaatgaggagtaggaggttggccatgggtatgttgttaagaagaggaattgaacctctgcgaaaacggcatcttcgtcggccgatgaagatgccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431445 - DNA, 1153 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431446 - DNA, 1517 bp, Homo sapiens
agcacagaggaggtggacagctggacagcatcagatggaggacagcacagaggggacagcacagaggatggagcacagaggaggtggacagcacagaggaggtggacaccacagaggaggtggacagcacagaggaggtggacagcacaggttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431447 - DNA, 1367 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagacagagtctcaccctatcgcccaggctggagcacagtgacgcgttcatggcccactgcagcctcaaactcctgggctcaagtaatcctcccactgtagcctcccaagtagctgggactacaggggcacaccatcacgagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431448 - DNA, 1851 bp, Homo sapiens
  misc_feature (75)..(75): n is a, c, g, or t
  misc_feature (207)..(207): n is a, c, g, or t
  misc_feature (217)..(217): n is a, c, g, or t
ttgtcgcagtctagctggtgtttctctcatttcgttcttgtgtgctctgtttgtgtttcgtgcgcggagctgtgngttgtttgttgtgctgttatggttgtgttgtcgcgttgttgtctgcgttgtgctgttgcttctgcttgtctacggttgtgcgtgctttgtttgttgtgtctttgctttccggtattgatttagcggaccccnccagtgtaangattgtatttaatctattaccctcgccgtgaggactttttgtgccccgatgcgtgtgatgcgtgggggttgtcacactgctatcgaccgcctgtttttttgtcgtctctgggcgtgatttatttttcgtggttggtgttggtcgtcctatgttttccgctcccccatgtggtggtgtcttttctccgtcaaagtatgcgggcgtgtgctgctgtttgtttcctgtcctcgcgtgtgtttttttatcgcgccccggtcgtctgttttttttatataagtcctcttttttgtgggggcgcctctttgtctttgataataagagggtggtgtgttatcaatttggtccccccccggtttttttgcccccccccccatttttttttttttttgtttttttttttttttttttttttttttttttttttttttttttttttttttttttttttttttttttttttttttttgttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaataggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttacaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgta

SEQ ID NO: 431449 - DNA, 1016 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcaacgaacctggtcgacaacagaagaagaaaatacgagagacaagaagagaaactgaagaataactacagagatctatcaatggttcgaatgaaatccatgtttgctattggcttttgttttactgccctaatgggaacgatctattcgatattcgatctgagactggtggccaagctctcccagtaccactctagaggacaccccatgactctatacttctgaatcgcgattgtgagcagatctatccaccgatctacgcagtcctttgccgagaaaattgcgcttaggacctccatgcgtcggcaccaggctacgagctctctgcctgccccttcaat

SEQ ID NO: 431450 - DNA, 142 bp, Homo sapiens
tttttttttttttcttttagatttgatggtagagtggtggcaaagcttccttttacccctctttcttacatccaaggactgtctcatcgaaatctgctgggagatgacaccacagactgttccttcattttcctgtatattc

SEQ ID NO: 431451 - DNA, 1230 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431452 - DNA, 1850 bp, Homo sapiens
  misc_feature (75)..(75): n is a, c, g, or t
  misc_feature (207)..(207): n is a, c, g, or t
  misc_feature (217)..(217): n is a, c, g, or t
ttgtcgcagtctagctggtgtttctctcatttcgttcttgtgtgctctgtttgtgtttcgtgcgcggagctgtgngttgtttgttgtgctgttatggttgtgttgtcgcgttgttgtctgcgttgtgctgttgcttctgcttgtctacggttgtgcgtgctttgtttgttgtgtctttgctttccggtattgatttagcggaccccnccagtgtaangattgtatttaatctattaccctcgccgtgaggactttttgtgccccgatgcgtgtgatgcgtgggggttgtcacactgctatcgaccgcctgtttttttgtcgtctctgggcgtgatttatttttcgtggttggtgttggtcgtcctatgttttccgctcccccatgtggtggtgtcttttctccgtcaaagtatgcgggcgtgtgctgctgtttgtttcctgtcctcgcgtgtgtttttttatcgcgccccggtcgtctgttttttttatataagtcctcttttttgtgggggcgcctctttgtctttgataataagagggtggtgtgttatcaatttggtccccccccggtttttttgcccccccccccatttttttttttttttgtttttttttttttttttttttttttttttttttttttttttttttttttttttttttttttttttttttttttttttgttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431453 - DNA, 1490 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaata

SEQ ID NO: 431454 - DNA, 1184 bp, Homo sapiens
tccgagacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttacaagccaaatacatgacataagatcaataaagaggccaaatttttagctgttttatgtacaag

SEQ ID NO: 431455 - DNA, 1098 bp, Homo sapiens
aggaggagccgtgtgccctggcactgagcggccgcggggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431456 - DNA, 1749 bp, Homo sapiens
  misc_feature (75)..(75): n is a, c, g, or t
  misc_feature (207)..(207): n is a, c, g, or t
  misc_feature (217)..(217): n is a, c, g, or t
ttgtcgcagtctagctggtgtttctctcatttcgttcttgtgtgctctgtttgtgtttcgtgcgcggagctgtgngttgtttgttgtgctgttatggttgtgttgtcgcgttgttgtctgcgttgtgctgttgcttctgcttgtctacggttgtgcgtgctttgtttgttgtgtctttgctttccggtattgatttagcggaccccnccagtgtaangattgtatttaatctattaccctcgccgtgaggactttttgtgccccgatgcgtgtgatgcgtgggggttgtcacactgctatcgaccgcctgtttttttgtcgtctctgggcgtgatttatttttcgtggttggtgttggtcgtcctatgttttccgctcccccatgtggtggtgtcttttctccgtcaaagtatgcgggcgtgtgctgctgtttgtttcctgtcctcgcgtgtgtttttttatcgcgccccggtcgtctgttttttttatataagtcctcttttttgtgggggcgcctctttgtctttgataataagagggtggtgtgttatcaatttggtccccccccggtttttttgcccccccccccatttttttttttttttgtttttttttttttttttttttttttttttttttttttttttttttttttttttttttttttttttttttttttttttgttggtctgttactcggtggtggcggagtctacggaagccgttttcgcttcacttttcctggctgtagagcgctttccccctggcgggtgagagtgcagagacgaagggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431457 - DNA, 1803 bp, Homo sapiens
  misc_feature (75)..(75): n is a, c, g, or t
  misc_feature (207)..(207): n is a, c, g, or t
  misc_feature (217)..(217): n is a, c, g, or t
ttgtcgcagtctagctggtgtttctctcatttcgttcttgtgtgctctgtttgtgtttcgtgcgcggagctgtgngttgtttgttgtgctgttatggttgtgttgtcgcgttgttgtctgcgttgtgctgttgcttctgcttgtctacggttgtgcgtgctttgtttgttgtgtctttgctttccggtattgatttagcggaccccnccagtgtaangattgtatttaatctattaccctcgccgtgaggactttttgtgccccgatgcgtgtgatgcgtgggggttgtcacactgctatcgaccgcctgtttttttgtcgtctctgggcgtgatttatttttcgtggttggtgttggtcgtcctatgttttccgctcccccatgtggtggtgtcttttctccgtcaaagtatgcgggcgtgtgctgctgtttgtttcctgtcctcgcgtgtgtttttttatcgcgccccggtcgtctgttttttttatataagtcctcttttttgtgggggcgcctctttgtctttgataataagagggtggtgtgttatcaatttggtccccccccggtttttttgcccccccccccatttttttttttttttgtttttttttttttttttttttttttttttttttttttttttttttttttttttttttttttttttttttttttttttgttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaataggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaag

SEQ ID NO: 431458 - DNA, 386 bp, Homo sapiens
cagtgtttagtctgagaatttttgcatgttggttaattgtggccattctttaatttaaagttaaaactataatcttaggtagaaaaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacacacacacacacacaacacaatggcactgattttggtacaaaatcagtgccattggtgtgtgtgtacgtaactatatacatatgtgtgtgtgtgtatatatataatgtgtcataaccgtaaacaataaacaatatcaagataaat

SEQ ID NO: 431459 - DNA, 1808 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaataaaaaaaaaaaaaaaaaaaaaaaaaaaaaaaaaaaaaaaaaaaaaaaaaaggggggggcccccaaaaaaaatctccccgagggggggccacatgatgcgcgtcacccaaggtttcgcgggcagcaacaggggccccaaaagggagggctcgactaaaacagcgtgacagagggggcacgaggccaaaaaccgcgccggcaaacgggggacaacaagtgccgccaaagccgcggggaaccacccacggagaaggagcgcaccccctcaaccagcgggagggagagacaacactccggggcgggaaaaagaaccccaagagagagagaatacagcgagcccctcgagacggaaaaaacaataacaacacccccaccgactgaggagaaaatcagggcggacaacaacaaaagcgaagcaaagaaagcggcgacggacgagaaagaaaaacgggaccccaacgggaaagcagcacaacaacaacaaaacaagttatcacaccgggggcccccacagaaaaaaaaacgagggag

SEQ ID NO: 431460 - DNA, 1195 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaat

SEQ ID NO: 431461 - DNA, 623 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaat

SEQ ID NO: 431462 - DNA, 810 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtcatggttatggccagtcgaagtctttgttgaatcagttcggtccatttccagacgcttgcatgtcacgcacgatcgagtctatgtaggattacccatgggcgatactct

SEQ ID NO: 431463 - DNA, 1278 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaat

SEQ ID NO: 431464 - DNA, 2105 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcaggtaaggaacccggcggggggtccctggggttggtgtgagggagtggctccggcctgcggatgcccaccccgggggagccgtgcggagaagcaatcggtccgcgatgcagcccccgggccccgcggcgggcccgcgagccttccttgagcggagaggtgcccggcccggagggagccggcggtcctggggctacgacccttcggaaacacctgcctacgccatcagcgcaagcttttccgacacccctgccccgcacttcttggtgcagaaaatggtggtcagcttgcggggcggggcggctgaggcggggggcgagggtggcgaggagggccagggccagggccagggccagggcctcggggcggggcggggaaggggccggatggcggtagttcctagctagcgttctgctgcagcagcccccacttcccccaccccggcagtctgcaggtctgcggggctaagtgtcgcggcggcgcacctcgcgtcaagaatccggaggaggagactgcaaggataggcccaggtcggtgcgagggtcggtggtgaggcgggggccggaacgtgaggaaagcccagtctgagaccctaatccatgccttcaccctcgcccccctctaccccatgcaaccctccccttcccacacgccatcctcgtcctccattttgctgcctgcggaagcctggagatggatctacagggaaaatggtgggctttgcggaagggaggggctcggattgagggcaccccacagggcatactggcttctcaggtggaaaaaaatgaaatgttagagtataaagtcaagtccagggctctgaattttaaaaggtgcctagtagggcctctgtcctcagtgcttatcagtccaccaagaattcagcccattttctctctcttgtctcctaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaat

SEQ ID NO: 431465 - DNA, 1093 bp, Homo sapiens
  misc_feature (20)..(20): n is a, c, g, or t
tgcgtcagaggacctagaangacggagacgcaaagataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaat

SEQ ID NO: 431466 - DNA, 1047 bp, Homo sapiens
gattaaactcgagatacagctttttgcagtatggtgggttggttttggtgtaacgtcttcaacatgtcgcactggctatcaaagaataagaaaattattgagtatgagtgtgttttataaactttctgagtttttcagatgtcttaatatttttaatagaacttaataaaatgtctagattgaaaaaaaataatttcaaagttttgacagaaactgctaagcaaaatttttaagcaaactgctttaaataattttcattataaaaaatgttttatattctgaaatgagaattactatactttgaggttgcaatgaatttcacataaatggcaaagtataaccaaaaaaaatctcatgacattgttcaccacttttgccattcttggacccaaggctggaaaacattttcagacactgtgctttatcctgaaaggatttggtgaaaagggatctctgaggtgaatatctgctctgcttggcctttgagagaaggggagtgggcaaggctggtcttgggcaaattacttccacctccctttttgcccctgcttcagctccaggggagctggaaatgcacaggaggagtcagaagacctgggttcgagtcctggctctgccacttactacctatgtgactttgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattactattattgtttaaaacaaat

SEQ ID NO: 431467 - DNA, 2567 bp, Homo sapiens
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431468 - DNA, 1026 bp, Homo sapiens
gattaaactcgagatacagctttttgcagtatggtgggttggttttggtgtaacgtcttcaacatgtcgcactggctatcaaagaataagaaaattattgagtatgagtgtgttttataaactttctgagtttttcagatgtcttaatatttttaatagaacttaataaaatgtctagattgaaaaaaaataatttcaaagttttgacagaaactgctaagcaaaatttttaagcaaactgctttaaataattttcattataaaaaatgttttatattctgaaatgagaattactatactttgaggttgcaatgaatttcacataaatggcaaagtataaccaaaaaaaatctcatgacattgttcaccacttttgccattcttggacccaaggctggaaaacattttcagacactgtgctttatcctgaaaggatttggtgaaaagggatctctgaggtgaatatctgctctgcttggcctttgagagaaggggagtgggcaaggctggtcttgggcaaattacttccacctccctttttgcccctgcttcagctccaggggagctggaaatgcacaggaggagtcagaagacctgggttcgagtcctggctctgccacttactacctatgtgactttgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431469 - DNA, 428 bp, Homo sapiens
gccattttgaacatgtaaaatcactactctttgcaaataggaggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431470 - DNA, 459 bp, Homo sapiens
  misc_feature (67)..(67): n is a, c, g, or t
tgtatagagtgttgtcttcgggggaaccccatccccccgcagctggaacctctggccccgctcaggngacagaggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431471 - DNA, 438 bp, Homo sapiens
tggatagttaaaaagttttagagattgttagaacaaaaggaagagcttgaggggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431472 - DNA, 470 bp, Homo sapiens
  misc_feature (470)..(470): n is a, c, g, or t
gccattttgaacatgtaaaatcactactctttgcaaataggaggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattggcctcgttggcctcagcggtggagctctgcggccggaan

SEQ ID NO: 431473 - DNA, 383 bp, Homo sapiens
  misc_feature (1)..(1): n is a, c, g, or t
ncttgtgtaccggccctacgctttactgtcgaacccgaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431474 - DNA, 298 bp, Homo sapiens
gtcgtgcgtcactgactctcttaatttccaccgctacagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431475 - DNA, 521 bp, Homo sapiens
agcaataaatggtataacagtggcagagatgtactttaacaaagtctaaaaaaaaaatttattttcaaaaaaattttgcttttttctttcatattgctttataaagattgtttacaaattagcagtatccaaaattctagttaagatctatttatacaaacacttcacatttacagataagtttcagcagaaatgtatcttgacaaagtatggaaaagttaatttgaggcttcaatttcattttcttcatttctttttaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431476 - DNA, 396 bp, Homo sapiens
cccccacagatccccttcccccaaccctccacacacatatacttcctcattgtggtgagagaactggattccacttgagccaaatactaaggacagcttcagtgacagagcaggagatacctaggaatcagggctagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431477 - DNA, 319 bp, Homo sapiens
  misc_feature (8)..(9): n is a, c, g, or t
  misc_feature (20)..(20): n is a, c, g, or t
  misc_feature (27)..(27): n is a, c, g, or t
  misc_feature (51)..(51): n is a, c, g, or t
  misc_feature (58)..(58): n is a, c, g, or t
accagtcnncccccccccantttaccncccccccggcctcccaactaatangaaaagnaatagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431478 - DNA, 393 bp, Homo sapiens
  misc_feature (354)..(354): n is a, c, g, or t
  misc_feature (358)..(358): n is a, c, g, or t
catcaatgtcaggaaaatgatcactgtaaagataactgttacagaactccatgatgccagcagaacaggcagcagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattagatgcgccaagctttttttntttnttttttgtgtctttttctctcttaggcgggagtgc

SEQ ID NO: 431479 - DNA, 876 bp, Homo sapiens
  misc_feature (791)..(791): n is a, c, g, or t
  misc_feature (866)..(866): n is a, c, g, or t
  misc_feature (876)..(876): n is a, c, g, or t
ccccccgccacccgacacacaaaacggggacgccgcggtgaatcccgctccttaaaacacttatgggggaccaggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattaaaaaaaaaaacacacaacaccaaaaaaaaaaccagaaagcagaaagctcggcccacccacccccctcgcgcaacacctcccagcactcctccccgtccggcctcacgcagaccgacacggcgcgcccccctgcgccccacagggccgacgcctgctgcgccccttcctttttctctgggggcccccctcccatgattcccccgcccatcacgcccgtccgtcacacagccccgacgtccgcatcgggcatgttccttacttccgtccacccgcgggcccacccccgccgtccccatccactcgcccgcccttcctccatccacccacactcntcctaccgcaccgccctcaacatcgccatcatcttctcacgaggaccgactcttcgctcgcctctcccactccantccgtgcccn

SEQ ID NO: 431480 - DNA, 349 bp, Homo sapiens
  misc_feature (299)..(299): n is a, c, g, or t
gtcgtgcgtcactgactctcttaatttccaccgctacagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattantgatgcgaaagggtactcctttcttataaaaactacaggtaaaacgaagg

SEQ ID NO: 431481 - DNA, 2963 bp, Homo sapiens
acccgtcagtctcctcaggccttatcctgccctctctgaggtggccgcctgtgggcgctgcaaacgccacacttttgctctacgaagaacctcctcgcgactttccaaggtgtgcaactcagaaaagcgccccccaaaacaagtaaaagccttcggggaagaggcaaagtccctgaaccgtcctgactccagccaccagccggtgtttggtggatcaggtcccggagctccgcagcctgggagccccacaccaggccggcccctacggccgctcagaaaacgcggcgagcggaacccgcacgcggaagcgccggccgcactgagcatgcccagttgcagagccgaccagaggagttttttcttttcttttctttttttttttttaaggggggggggtctcaagtaggaggcctccccatcacccccaccccagccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431482 - DNA, 2503 bp, Homo sapiens
agcggatgtatatgccaagtgacttctgaacacgacgtgaagacagtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431483 - DNA, 2478 bp, Homo sapiens
catttattttattttaacaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431484 - DNA, 2620 bp, Homo sapiens
catatgtcaaaaataagcctaaacacaccaccgggaacaccagttaagctcgcacggccttgttgacctacgcaaatggattccagctctatgaatgactctaacaccacagttcttggcggtgaagtggaacaccttatcgagaaatgggggttaccgagagtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431485 - DNA, 2428 bp, Homo sapiens
  misc_feature (22)..(22): n is a, c, g, or t
  misc_feature (28)..(28): n is a, c, g, or t
  misc_feature (39)..(39): n is a, c, g, or t
  misc_feature (43)..(44): n is a, c, g, or t
  misc_feature (52)..(52): n is a, c, g, or t
  misc_feature (69)..(69): n is a, c, g, or t
aaaaaaaataaaaaataaaaanaaaatnaaaataaaaanaaannaaaaatanaatttaacaatactganacaatgttcagaattcctccccatgacacaatagtggaaaggtagaaactcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431486 - DNA, 2570 bp, Homo sapiens
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagtttggaagaagaaatagccaagataaaagaaagtgtgaagtcctatggtgtgatccatgttgatgaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431487 - DNA, 566 bp, Homo sapiens
  misc_feature (26)..(26): n is a, c, g, or t
  misc_feature (29)..(29): n is a, c, g, or t
  misc_feature (42)..(43): n is a, c, g, or t
ggacggaggggccgctagggcgcganagnattaggttagganngggggttgcggattttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431488 - DNA, 930 bp, Homo sapiens
gattaaactcgagatacagctttttgcagtatggtgggttggttttggtgtaacgtcttcaacatgtcgcactggctatcaaagaataagaaaattattgagtatgagtgtgttttataaactttctgagtttttcagatgtcttaatatttttaatagaacttaataaaatgtctagattgaaaaaaaataatttcaaagttttgacagaaactgctaagcaaaatttttaagcaaactgctttaaataattttcattataaaaaatgttttatattctgaaatgagaattactatactttgaggttgcaatgaatttcacataaatggcaaagtataaccaaaaaaaatctcatgacattgttcaccacttttgccattcttggacccaaggctggaaaacattttcagacactgtgctttatcctgaaaggatttggtgaaaagggatctctgagctccaggggagctggaaatgcacaggaggagtcagaagacctgggttcgagtcctggctctgccacttactacctatgtgactttgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431489 - DNA, 2626 bp, Homo sapiens
  misc_feature (2587)..(2587): n is a, c, g, or t
  misc_feature (2591)..(2591): n is a, c, g, or t
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattagatgcgccaagctttttttntttnttttttgtgtctttttctctcttaggcgggagtgc

SEQ ID NO: 431490 - DNA, 454 bp, Homo sapiens
attttatttccgctttccggcgccgcggcgtcagcgtttgtgtgcaacattgtgcgttcagaggtataggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431491 - DNA, 447 bp, Homo sapiens
gtggggggggacaccgtttattaggtgaagggcgggggggcggggcgccggtggaattcagggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431492 - DNA, 459 bp, Homo sapiens
ccccccgccacccgacacacaaaacggggacgccgcggtgaatcccgctccttaaaacacttatgggggaccaggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctatta

SEQ ID NO: 431493 - DNA, 2609 bp, Homo sapiens
  misc_feature (2609)..(2609): n is a, c, g, or t
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattattggcctcgttggcctcagcggtggagctctgcggccggaan

SEQ ID NO: 431494 - DNA, 2595 bp, Homo sapiens
  misc_feature (2568)..(2568): n is a, c, g, or t
  misc_feature (2575)..(2575): n is a, c, g, or t
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattangatgcgnccggaagcctgtcttcatac

SEQ ID NO: 431495 - DNA, 2984 bp, Homo sapiens
  misc_feature (2899)..(2899): n is a, c, g, or t
  misc_feature (2974)..(2974): n is a, c, g, or t
  misc_feature (2984)..(2984): n is a, c, g, or t
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattaaaaaaaaaaacacacaacaccaaaaaaaaaaccagaaagcagaaagctcggcccacccacccccctcgcgcaacacctcccagcactcctccccgtccggcctcacgcagaccgacacggcgcgcccccctgcgccccacagggccgacgcctgctgcgccccttcctttttctctgggggcccccctcccatgattcccccgcccatcacgcccgtccgtcacacagccccgacgtccgcatcgggcatgttccttacttccgtccacccgcgggcccacccccgccgtccccatccactcgcccgcccttcctccatccacccacactcntcctaccgcaccgccctcaacatcgccatcatcttctcacgaggaccgactcttcgctcgcctctcccactccantccgtgcccn

SEQ ID NO: 431496 - DNA, 2618 bp, Homo sapiens
  misc_feature (2568)..(2568): n is a, c, g, or t
acccgtcagtctcctcaggccttatcctgccctctctgaggtggccgcctgtgggcgctgcaaacgccacacttttgctctacgaagaacctcctcgcgactttccaaggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagtagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctattantgatgcgaaagggtactcctttcttataaaaactacaggtaaaacgaagg

SEQ ID NO: 431497 - DNA, 1306 bp, Homo sapiens
acccgtcagtctcctcaggccttatcctgccctctctgaggtggccgcctgtgggcgctgcaaacgccacacttttgctctacgaagaacctcctcgcgactttccaaggtgtgcaactcagaaaagcgccccccaaaacaagtaaaagccttcggggaagaggcaaagtccctgaaccgtcctgactccagccaccagccggtgtttggtggatcaggtcccggagctccgcagcctgggagccccacaccaggccggcccctacggccgctcagaaaacgcggcgagcggaacccgcacgcggaagcgccggccgcactgagcatgcccagttgcagagccgaccagaggagttttttcttttcttttctttttttttttttaaggggggggggtctcaagtaggaggcctccccatcacccccaccccagccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataaggtgattggcactttattttgtgtatttgttacagaatgttgaaggtgctattcaattggaataacttaagaattttgaaaagtaggaatggacccttaattgtgtgttacagtttttcagatgaaattatagagcttttctgcatttctgcttcacctgtataaaaatagttaagaatatatggccaggcgtggtggctcaagcctgtaatcccagcactttgggaggccaagggggacggatcacccaaggtcaggagttcaagaccagcctgaccaatgtggtgaaaccctgtctctacaaaatacaagaattagccaggcatgatggcgggtgccggtaatcccagctacttgggaggctgaggtgggagaatagcttgaacctggtaggcggaggttgcagtgagctgagatcatgccattgcacttcagcctgggtgacagtgggactgtgtctcaaaaatatatatatataaaataaaaataaatta

SEQ ID NO: 431498 - DNA, 2256 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431499 - DNA, 1091 bp, Homo sapiens
  misc_feature (4)..(4): n is a, c, g, or t
  misc_feature (63)..(63): n is a, c, g, or t
  misc_feature (78)..(78): n is a, c, g, or t
  misc_feature (90)..(90): n is a, c, g, or t
  misc_feature (94)..(95): n is a, c, g, or t
  misc_feature (98)..(98): n is a, c, g, or t
  misc_feature (100)..(100): n is a, c, g, or t
  misc_feature (147)..(147): n is a, c, g, or t
gggntctccgcgcgttcgtgtttttctccttttttctttttttttccctcttttctccctctntttctttttcttttntctttctttttnaccnnttntntctccctctttttttctctcttttttttcctctctttttttccctcnttttttctccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431500 - DNA, 1764 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtc

SEQ ID NO: 431501 - DNA, 2267 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431502 - DNA, 2266 bp, Homo sapiens
ggaccgactatgcataggtcgatgccgggtttaatcaggcctgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431503 - DNA, 2193 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctccccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431504 - DNA, 2202 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagatccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431505 - DNA, 2213 bp, Homo sapiens
aaaaaatctgcaccattacaggccgtactggtttattatacaggctgggtctattagtgttgcgtgatgccatacacggcctgtggctaacagagtggggatgatcgagaggaatcgacagcgggatggagcacgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431506 - DNA, 2031 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431507 - DNA, 2213 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431508 - DNA, 1229 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttccttttctattcctgttgctctgtttcttcctttctgtaggtttctcttatccct

SEQ ID NO: 431509 - DNA, 1657 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431510 - DNA, 1473 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctggagtggctacacctccagccaggttgaaggcctggcgggagctgcatacgtgaggactagaagcatctcgatcgatttagcaggttcctccatctcagccctgtgtcggtagtagggtctctgtagtgtggatggcctctggtggctcacttcaaaggtctcgatcaagtacttgtctacccaggcaacctggcagctcggtcactggaccccagggggtcgtcctggcgccacgaaacgcggctgatgaaccaattccccaacctcctgtctcacgatggccgcgacagtctccgtgaagaccagccccagaacagcagacggacgttcgttccccaacgacacgtaccagaggacggcaaaacagacccggaaaacggcgacgagtgacatccccgtgagcgaggcggcgagacacaacagaccgcaag

SEQ ID NO: 431511 - DNA, 1364 bp, Homo sapiens
gcgaattcactagtgattagagactaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttg

SEQ ID NO: 431512 - DNA, 1362 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctggcatggtcttactcggtcccagcagtaatggacagttaccactctcgggaaggggtctgtcatctggcttcccgggcacggtgctctccggtattctatcagcttctctagccactccttcccggtcttcttggcggattcctcctctgttcctgggggctgatcctgggccacttttctctctgagccctctcctcaggtaatctcttccattctctgggtattacatagcaaccaggtgttggtgactcacaaatttttgtgagcccagacatgtcccatgtgttccaactcgaggttctaactgcccctgtgacatc

SEQ ID NO: 431513 - DNA, 985 bp, Homo sapiens
tagtagagcctggtggttaatggcgtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggtaatgaatggggctgctgcttctccattgacccatttctaatgagaataaaactgtctttaaagaagccctcgtaagaggcaaaccgaagacccttcagaacctcccgtgtcggtgctctgaatgccagccttctgaggatgcacacctcggggggtgagggctttgaggtgtagtcagatgcagcccacccaaagtccaacatttcttagaaattttgctttatatctcaaacgtcctctgtataagatgaagatatttttagttaatctctaagggagaggaatctactcaccggg

SEQ ID NO: 431514 - DNA, 1005 bp, Homo sapiens
tagtagagcctggtggttaatggcgtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggtaatgaatggggctgctgcttctccattgacccatttctaatgagaataaaactgtctttaaagaagccctcgtaagaggcaaaccgaagacccttcagaacctcccgtgtcggtgctctgaatgccagccttctgaggatgcacacctcggggggtgagggctttgaggtgtagtcagatgcagcccacccaaagtccaacatttcttagaaattttgctttatatcctaaatacgcccgagatttgtaccttctgctccataatgttcccgtgttgttttcacattttttaagtagatgtccctaataatttttgg

SEQ ID NO: 431515 - DNA, 1809 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtcaaagcacttacctagctgagcctgactcttcccg

SEQ ID NO: 431516 - DNA, 1745 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagcccccatccaggacctcattgcctcattggaaccaaagatgcccctgtcacccaggaaattccaaaggatttaggagctctgcgtcaggagccaggatcacagaccagataatagaacaaaagatgctcctagcacccctgctgcttaggaaatgacacaggttttaggatctctgtgtcaggaactggaggctgagaccaacacatatgttatcatttcacagtgataggtcaaacaggtcatggtaatggtgggagctacctcactgggggcctatgggggtgaaaggagatcatgggtgccctcagcacaccacttgggtgaagggttagtaccagaccccacttctggttttgtctgccagcctggggctttttttttccccttacctattagattatttcataactcttttcctaccagaaatgcatctcctgctagactggtccagatcaaaagccctgctctttcactgaggctctcccggttggcatatcctgcagaatccctccgtccagagatcagtcggtcctgtggttgtttcacagagtgactcctctgtccagagatcagtcggtcctgtggttgtttcacaggtgacacctccgtccagagatcagttggccctgtggttgtttcacaggtgacccctccatccagagatcagttggtcctgtggttctttacccctggtggtcatttcactcaccctcatatgcagtcgttcctgtgtccatcttccttcctggagcccacattcctccaggccaggactgtggcttctctctgaattgccccacagcttttttccaagtgctctgctcacagtagacatcaaatagatgcttgttgagtcatggtgcgggaatgagggagcctagagaatatctttctggatcctctactgttgatactagaaggagcctaagaagccacccggctgatggttttctgaccctgcctttatcagcagagccttttttcaaatgaggtgttgcacaaaagcctgatgtgtggctgtgtaaaacagaaataaacagtcttctagccaaagccccattcccacagttcagggggccataggcccaggaattccataggatgtcactgcccaactaggaaactgctcagttagctgaaccccttctgagggccagaggaggacaggatttgtcccaatccagacactcggccagggaat

SEQ ID NO: 431517 - DNA, 1294 bp, Homo sapiens
tatattatcaggactctcttaaccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtcaaagcacttacctagctgagcctgactcttcccg

SEQ ID NO: 431518 - DNA, 1532 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatagccaaggaggagttactggaggggcagtgacctgcaggaactacaggacaatcgtggagtcggtttgaacgatgctgagcgtgctgctgcgcgctgcacacttgacacgcaacgtccgctgcaatgtctgggcaccacgttcttgcctcgatgcctctcgaacgctgagcaccagcaggccttccatccctccaagggcacctacatccacgacccagtgcttgccgactgcgacggacggccagagtaaccactcgcacgtgggagactgccttcataggccagacccaagaacgtgcagcgcccccaagcgcatgacatatcgaacactggccacggcagagtgatagccccacttccctcaattaccttacacactccgtactatggctcgcacccaatatcgtcaatcatccgtccaaacacttatagcttcacttcacgtcattatcatatagacaatcctaacacatttcatcaccgtcctatcatttacttcctacacatatcatgatatactatacacataaacaccatggacccagagcagacaatatacacctacattacttatcatccctccttctacctattcaccttccttccctacttacttatcaccataagtagaacaattctactcacactatatccccccccctaactataagatacttacataccaatccccaacatttccacacacaccataaacacagatacactaacagctacacctaatatcgatcaaatatcacagtactatacaaataattatcttacaaacacccacactattcatgagcctaaatcccactcccccgtctcacgtctcatgcaaaataaaactaaaacacacacaattcataacaccaacatgcaaacaattctctccatcccgaccatacactgcatcatacccattcccacccatacccgctgatccactcttataactggtcccctcatatacacaaaccccctccaactaaaacatacctgacaacgaccactctatcaatacacatcgaactcaccactcctctactctccaacctcatccacaaacaacactacacacagaaactcccacttcaacacataacacacgcatgaaaaccaactgtgacgcgccaacccactaaaactatcgacaatacacctagccaccg

SEQ ID NO: 431519 - DNA, 399 bp, Homo sapiens
ttagggctacatgaatttgggggaggtgacacgattcagtccatagcaaggaccagtcctgtgctgttttgtctgtctgtggagggtgcttgggatcaacactgagtatcttgtctcccactgggcaggccagggatccagcagggatgtcacgacagctctgtcacagacctgctgtgagggcagggcctgccaaggcgtccgggtgactgcctgcctctcgtttccctccccaggatccttctttccacctcagcctggcctggtgtgtgggtgatgcacgtctccagctggaggggcagtgcctgcaggaactacaggtgaatttccagggcgggagcacagagggcgctgaactccagaaatgacaggacagatgctggagagggggaggatgag

SEQ ID NO: 431520 - DNA, 579 bp, Homo sapiens
agatagggcttagtacgaggctggtgtgaattcggccgagggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgagtgcttcttccctctgcctctccactccctcc

SEQ ID NO: 431521 - DNA, 1013 bp, Homo sapiens
  misc_feature (4)..(4): n is a, c, g, or t
  misc_feature (7)..(9): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431522 - DNA, 908 bp, Homo sapiens
  misc_feature (4)..(4): n is a, c, g, or t
  misc_feature (7)..(9): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431523 - DNA, 956 bp, Homo sapiens
  misc_feature (905)..(906): n is a, c, g, or t
  misc_feature (911)..(911): n is a, c, g, or t
  misc_feature (913)..(913): n is a, c, g, or t
aataagcatagtcgaggccgggtgttaatcggacagggtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccatccnnagcgngnggaattattgggaagtggacggagggaattaaaaaacttcttt

SEQ ID NO: 431524 - DNA, 349 bp, Homo sapiens
agatgagcaaggcctcacccagctccctgctggctaagttctcagaggatactctcagcagctatacggaggctgtctcccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431525 - DNA, 1074 bp, Homo sapiens
  misc_feature (4)..(4): n is a, c, g, or t
  misc_feature (7)..(9): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaaaacacaacacaaaagccgggcatattcgtgggcacaacacgtaataagagcacagtgttaa

SEQ ID NO: 431526 - DNA, 978 bp, Homo sapiens
  misc_feature (4)..(4): n is a, c, g, or t
  misc_feature (7)..(9): n is a, c, g, or t
  misc_feature (927)..(928): n is a, c, g, or t
  misc_feature (933)..(933): n is a, c, g, or t
  misc_feature (935)..(935): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccatccnnagcgngnggaattattgggaagtggacggagggaattaaaaaacttcttt

SEQ ID NO: 431527 - DNA, 727 bp, Homo sapiens
gcctactactactactaaattagcggccgctcgatctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431528 - DNA, 833 bp, Homo sapiens
  misc_feature (4)..(4): n is a, c, g, or t
  misc_feature (7)..(9): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggcttgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431529 - DNA, 770 bp, Homo sapiens
  misc_feature (4)..(4): n is a, c, g, or t
  misc_feature (7)..(9): n is a, c, g, or t
ggcncgnnngtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 431530 - DNA, 666 bp, Homo sapiens
aataagcatagtcgaggccgggtgttaatcggacagggtgcactatggctcggggctcgctgcgccggttgctgcggctcctcgtgctggggctctggctggcgttgctgcgctccgtggccggggagcaagcgccaggtacgcgggactccggggtcggggaaccccgggccggggctcgggagccggactgggtgtctggagaacagcgccgaactgggggaacaggcggatgtggggatctggggtcaggtggccttcaaacagctcgctcccggctgtgggaagttccatcactctccaagcttcattcacaatccgggcctcagtttctcccaccgtccaattggggttgggggggtcttcagttccacaagtccgaagtacttcgaatggagagagaaagtgagtgagggcgggatgtttagtctaggaaggggcacgcccccagcctggtccgtacagggtctaactagccccagtgatcgacgagttggggaggccgtcgagaggcactagggtctgtgccctctataccatgtggggtgcccccttccatccggtgacttcagtgcccagctatgcggggggagggactggggtcgggcccggtgcccaggagtgagtcacccgccggcggcaggggggttgtggggacctgacccc

SEQ ID NO: 431531 - DNA, 102 bp, Homo sapiens
gagggcgccggtgactcacgttattcgagccggccgaccctgacctcagaccccagaatagccgagtcccgcccccagcctctgacccgaggccccctcccc

SEQ ID NO: 431532 - DNA, 253 bp, Homo sapiens
ggtttgatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaaggtgagcctctgcagaagacagacccttggctggctggctgtcgggttggtgccttatttatgtgtgtatc

SEQ ID NO: 431533 - DNA, 2195 bp, Homo sapiens
cggggttcggtgcgcggccggggccggagttcgctgcaagtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431534 - DNA, 2347 bp, Homo sapiens
tagtctagatcgcgatctagaactaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431535 - DNA, 2312 bp, Homo sapiens
ggcttagcattccaggccctgggcatctccaagtgccccaggtgggggcactctcctggggtctgtgacagcttgcccccaaccacggagaggtgacaggcacgagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431536 - DNA, 2218 bp, Homo sapiens
ggcttagcattccaggccctgggcatctccaagtgccccaggtgggggcactctcctggggtctgtgacagcttgcccccaaccacggagaggtgacaggcacgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431537 - DNA, 2784 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggacccttcgtgcatgtttgtgcatgtgctctcctcttgcatgttgtgtgtgtctttggtgacctctgtgtccctcgaccagtagtctgatgccatctgtgctggttgtgcatccgcatgtagattgacctgctgctgtgtcatggtatgccatgccatgtcatggcatccaatttgtgcatgctgtgttgtgcatgttgtgcatgcatgtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431538 - DNA, 2950 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtggatggtaaggaaacaggctggagggatacaagaatgctgtagggcacagaaaaaaaaaaaagacaaacaacgacacacagaacaaggtgggcgccacaaaagaccccaggggcaaagatacaaacccgcttatggaagaggcccacgagagaacaaaacaaaagcggcgacaacgcgcgcgaaaacacggcatgagagcaacccgggggacagcaccacaaaacagaagacaagaaccacaactgcgatcgaccaaaacgaacaagaaaccaagcacaagtcaaacaccgagaacagcacaaagaaga

SEQ ID NO: 431539 - DNA, 2487 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaaggaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431540 - DNA, 2735 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggaggtaacggcgccttagagggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431541 - DNA, 787 bp, Homo sapiens
ctttttatgctagggacgtggagatgttaaaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431542 - DNA, 2714 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431543 - DNA, 2534 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431544 - DNA, 2419 bp, Homo sapiens
cggggttcggtgcgcggccggggccggagttcgctgcaagtcggcggaaagtttggctgcgcgggttcccccgaagttcagggtcctcttgcctgcccagcttgggctgatggagacagatgtaattatggaattttgcttgggaaattaatttgaaaaagttaattaattggtggttccggaggtggcgggctccacgcccggccagtcttgctgacgtcagtgctgacccactggagacgtgcagcttccgggcaagctgggcagagggaccccggtgacctggctgggcagccctggaacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431545 - DNA, 2297 bp, Homo sapiens
ggtttgatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431546 - DNA, 2436 bp, Homo sapiens
aggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431547 - DNA, 2075 bp, Homo sapiens
cggggttcggtgcgcggccggggccggagttcgctgcaagtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431548 - DNA, 1794 bp, Homo sapiens
gcttggagaaggcaaggggttcccatgctgctatctctgcacccctgtggcagggcccgtccctgtgcccccagatgcagcaacctagctggagtgccaggcctgggtacaaaagcatcttttcagcctgcagtccctgcccttgtccccgcccctctatgagtgggcttgacgcaaatgtccagaatggttggaaaacaacagtggtatatcccagccatggcctcctggttaccctcccccaaccccagccccacccttccatttctgctctcctatgtacacacaaaggcacccactttagtccagtgtagacacacatgcacacacacatagacacggccgcttgagaaatagctcaaatacccacctcccacagctccataccacacagctcagcatagcacgaggcacacacccatatgcacacccgtcgcacgtgctcacacgctcatttacagaaacatgccacagccacctggcgctgttgcctttgggccaggggaagggacttcttctctggaaggagggttcctgggcacagtggctcaggaggcctcagagtcctcggggccttccagcagcccagcaggtcaagcgcctcctttggcctggctggggtggcaggagctccgaggggtggctgctcttcctccatgcctgtccctccgccatgaggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaaaaaaagctgg

SEQ ID NO: 431549 - DNA, 709 bp, Homo sapiens
agtgattagtactagtagatagttggcaggaacattgagcttgatgtcaaacacttgctcgcatgagagtctgacgctcttcgtggtgcgagtgctcctctgagcttgctaagtcggtagatcatcataatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431550 - DNA, 1411 bp, Homo sapiens
  misc_feature (1353)..(1353): n is a, c, g, or t
ggctgcaggaattcggcacgaggaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttttggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttcgggncctgatgtggggcggaaagatccagttaacacgtgcctgggaataatcccggcaggga

SEQ ID NO: 431551 - DNA, 595 bp, Homo sapiens
ttcgattccaaagaaaggcttctaaagaagaccttataatataaaaaaagattcttagagaaggtaattattcgactcccaccttatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431552 - DNA, 454 bp, Homo sapiens
aaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagct

SEQ ID NO: 431553 - DNA, 2956 bp, Homo sapiens
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431554 - DNA, 3473 bp, Homo sapiens
ggctgcaggaattcggcacgaggaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttttggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431555 - DNA, 3779 bp, Homo sapiens
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgagggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaagagt

SEQ ID NO: 431556 - DNA, 2813 bp, Homo sapiens
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431557 - DNA, 2927 bp, Homo sapiens
tacggctaaggtacgaggcctgggcttgtggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431558 - DNA, 2143 bp, Homo sapiens
agctagatagaggcccgtgttaatcggccgagggttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431559 - DNA, 1757 bp, Homo sapiens
gcagatgtacgaggcagatcccgggttttaatttcagtcacggggctctgtttgagatggacatataactgttccggcttggcttgcagacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431560 - DNA, 1651 bp, Homo sapiens
ccagtggtaaagcgtccagtggtgtagacagctctggggctgaactcctccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431561 - DNA, 2364 bp, Homo sapiens
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatggtaaatataaattactgttttacagtgattgatgcattgtattggactaactctgttctggacccaggattcttacctggacataaacccccaaatgcttggcattttcccaaaatagggtatgaaaag

SEQ ID NO: 431562 - DNA, 1675 bp, Homo sapiens
  misc_feature (1332)..(1333): n is a, c, g, or t
  misc_feature (1401)..(1401): n is a, c, g, or t
  misc_feature (1585)..(1585): n is a, c, g, or t
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaacctgtgggagccnncaaggatgagaaactgccattgtgttttaagtttccctggagcctatctgtaacaaggttcatataanactaagcaaaaaattactcttggcgctggaggcacttaagaatcctaccttgcctcttcctgtcttctggtggttgtcagtaatccttagtgttccttggcttgtagctgcattactccaatctgttgctgtcatctcatggtcctcttcgtgtctctctcatgatttgtcattggatctagangccaccctaatcaaatataacgtcattttacctaattatttccgtaacgagcttatttccaaataggggcacattctgatgtctagttgg

SEQ ID NO: 431563 - DNA, 1002 bp, Homo sapiens
atgcttttagtttctgttggcaagcattctcagaggtggtgaagcataagaagatgaagaaaagaccttcatactttgaaatcttaatagctttaagaaacatatttcttataatctcttttattaggtttctctccttatggataaaataaggcatgctttaatacaagtgatatgacttgttatttcaggcttatgctagaacattgcggaccttacgtcaccagatgtactttcggacggcttgacatttatctaatctgtacattatctcgttgtatatgtggcagagatttacccaaggactgacagtacgagttgctaggataatttgaatgtgtttttttgttgcagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431564 - DNA, 1012 bp, Homo sapiens
  misc_feature (842)..(842): n is a, c, g, or t
  misc_feature (844)..(844): n is a, c, g, or t
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgacttttcgggccctgngntgtgccgaggttccagttgcaccggccgtgggactatccggcggggtggggtcagacacggttcgggccggccggtggccgcttgggcgcgccgggggcccccccgtgcggcggcgtggcccggctcacccgtggggcggtggacccctcgctgtagggggtgtcacc

SEQ ID NO: 431565 - DNA, 894 bp, Homo sapiens
  misc_feature (836)..(836): n is a, c, g, or t
gcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttcgggncctgatgtggggcggaaagatccagttaacacgtgcctgggaataatcccggcaggga

SEQ ID NO: 431566 - DNA, 1288 bp, Homo sapiens
ggctgcaggaattcggcacgaggaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttttggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctataggattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctga

SEQ ID NO: 431567 - DNA, 517 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431568 - DNA, 616 bp, Homo sapiens
  misc_feature (118)..(118): n is a, c, g, or t
tcagagtctgatcttatttatttgttactcaaaaaatcttatttctgactggattcagacttagaagtagaagctcgcagagaggaaagtctgcgtctcttcgcaatttgttcctggngcttctccttagcctccttcattctcttggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431569 - DNA, 729 bp, Homo sapiens
ccaacgaaatatgtacgaggacggcaccggtttttattcatccgcgggctggctgtttcgttgaagtgactgtgcgctggcgtacgataccatccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431570 - DNA, 523 bp, Homo sapiens
tcctcaccggggtgaaaggttagcggaagtgtccttctttcctttttgctgtaggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431571 - DNA, 439 bp, Homo sapiens
tcctcaccggggtgaaaggttagcggaagtgtccttctttcctttttgctgtaggcccgggtggttgctgccgaaaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431572 - DNA, 947 bp, Homo sapiens
ggtgttctgttatttacctgaagtgctgcagctgggaatctgtaagaagaggaggaaattgcttttagaaaggtcacatagcccctcactgttttcctcttatccatgattttgtagcttcttgagagagttccctaggctctggccacatacaccactgcgttttgttgttgtggggacactggagtacccctggattcccctctcccatctcctgagactgatctctggagttaggctgtggtgtcttaaccttggctgtacacttcactagcagtggagcaagtgaatagataccaagtcctgtgagcagtgcttggcatatagcaagtacttcttaaatgttaactgttgctacttttaaatctcttacctctagtaagccgttccagatgcttcctgatggagataaacactgttctgtttctctttggtcatttctcatagctttctgtgatttttctctttataatggtggatcttggagacctgagggtggaaatattttttggacactgcactacctctaacacagggcctaaataggccctcagtgaataacaaatgtaattcttactcatttaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431573 - DNA, 380 bp, Homo sapiens
gcggccgcctactactactactgctcgaattcaagcttctaacgatgtacggggacatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431574 - DNA, 760 bp, Homo sapiens
  misc_feature (26)..(26): n is a, c, g, or t
  misc_feature (31)..(31): n is a, c, g, or t
  misc_feature (36)..(36): n is a, c, g, or t
  misc_feature (572)..(573): n is a, c, g, or t
ccggccgcgcgacacggctgcgagangacgncaganggggagtgtccccctgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaacaaaaaaaaaaaaaaaaaaaaaatttggggggggctggggcctnngaaaaggtttttcaaacacccttccgtgtggcgggggggccccatttggtagtgaacactggggcaagacgggccaaggaaaccgcgccgactaggcgtggttctcacaaaaaaacgcggggacacagcgtttgaaacccgagggtcggggctaggtcctaacgggcaggacgttaccgcccgggga

SEQ ID NO: 431575 - DNA, 1108 bp, Homo sapiens
gcccttcaagggtatgagccccaggtatatgcccccctttgttgttgtgtttgtgtgtgtgttttgaagaatcggagcctgggtggcctaaaccacttgggggttcagatcctccgttttgtctaagattaagaaacggttcttcagaattttgttaagttgggggcaacccatataggccccccagttaatggaggttccttcaactattaggacttttcgcttcgaagcgaaggctttcctcagatgcatgaaaattgattaatattgactgcctgttagagaaatgaatgagcctacagatgataggatgtttcatgtggtgtatgcatcggggtagtccgagtaacgtcggggcattccggatagccgagaaagtgttgtgggaagaaagttagatttacgccgatgaatatgatagtgaaatggatttttgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaaaaaaaaaaaaaaaaaaaaaaaaaaagaaaaagaaaaaagaaggagagagagaaaaggaggaagcgaaaacacgaagcaaagacagacggacaaaagagcaaaaaaaaaagaccgcggagagaaaaaggagacgcacaacgaaagagaagggggggaggaaaagaaacaaacag

SEQ ID NO: 431576 - DNA, 554 bp, Homo sapiens
tcctcaccggggtgaaaggttagcggaagtgtccttctttcctttttgctgtaggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaaaaaaaaaacatttcttaaaaaaaaaatatgt

SEQ ID NO: 431577 - DNA, 705 bp, Homo sapiens
  misc_feature (527)..(527): n is a, c, g, or t
tcctcaccggggtgaaaggttagcggaagtgtccttctttcctttttgctgtaggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaatagnaaaaaaaataacaaacctttgtaataatgttggggcgcctttggcccaagctattttataatattagcaaaggttttatctgtgcggcgcaaatttgggcctatttgtgccaattgccccttatagggagggtattacaaatacttgggcccgggtttataaacaccggggagggtga

SEQ ID NO: 431578 - DNA, 1032 bp, Homo sapiens
gcctcctgcgcgtactccacttggaagaggtggccctcgggcgagaaagcggtgatggcgcggtcgtagctcattccggcggcggcggccgggctccttccgccgcgactttccaaagcgcacactcacggcctgcgcgcacccgcgactcccggggcccatacgcccgcgccccaacccttggggccgtgtcctgcgctgtccggctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaactaaacacagcagaaaacaacacaaaaaacacgtgtgttgggcggccgcggggcctcgagaaaagttttcaaacaacaaactggttgggggcgcggggccccacgcgggcaacagcgcacacgcgggggctcaacagcggtggtcccccaaaagagaaaaccggcggggcagagaaacaaagcgggcccgcgggcgaattcctcacaccagttagaaacaacgcccgcgcggggaaccagcggaggcgtttcggaacacaaaaatccacagaaagagcggatccggagggacccatagcgcgggcccatcaacacggggtgtcccaaggggaactctgctaaatacaaagtaagccgcgcgcggggc

SEQ ID NO: 431579 - DNA, 579 bp, Homo sapiens
  misc_feature (54)..(54): n is a, c, g, or t
  misc_feature (78)..(79): n is a, c, g, or t
  misc_feature (99)..(99): n is a, c, g, or t
  misc_feature (557)..(557): n is a, c, g, or t
  misc_feature (562)..(562): n is a, c, g, or t
  misc_feature (564)..(564): n is a, c, g, or t
aagagtggtatcaacacagagggcccattacggccgggaagagtggtatcaacncagagtgcccattacggccgggannagtggtatcaacgcagagtngccattacggccggggcctttttgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaactgctnatcangncttgttgtcataata

SEQ ID NO: 431580 - DNA, 464 bp, Homo sapiens
  misc_feature (1)..(1): n is a, c, g, or t
  misc_feature (408)..(408): n is a, c, g, or t
  misc_feature (440)..(440): n is a, c, g, or t
ngggcagcatggaatttgggcacgagccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagaggaggaggtaccaanggtcaaggcaatgtccaaagtgggttctttcnagaaaccttgtggttttttagggt

SEQ ID NO: 431581 - DNA, 920 bp, Homo sapiens
tcctcaccggggtgaaaggttagcggaagtgtccttctttcctttttgctgtaggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaaggtatcagcctcgcgggactctgcgtccttgcatgccgggaccaggctggctgcggcggggcgggcaggcttggaattcaaggcctgtttctggggcagtagccagtgagcacggtcagggtgaacgtgggagagcttttgagagaggaagaagcacagtaaaagcaaatgtgagctgaattgggctcccaacgcataaagccttctccaccagaggctttaaatatatagtaatagtggctgacattgcacgcttgctatgtgctcccactgcctttcaggtattgtcatgtgcagtccttgaagtaatcataggggattccttttcttttcttttcttttctttttttgagacgggatctctgtccaggctaagtgcagtggcgtgatcactgcagcctcgacctcccgggctcaagcgagtctcccatctcagcctctcgagtggctgggactacaggtgcgtgccaccatcccagctataggggg

SEQ ID NO: 431582 - DNA, 273 bp, Homo sapiens
  misc_feature (22)..(22): n is a, c, g, or t
gctactactactactaaattcncggccggtcgacgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggtttactgcggttttagatgctttgttttgatcattaaaaattataaa

SEQ ID NO: 431583 - DNA, 277 bp, Homo sapiens
ggagtttcccacaccacacccacaaaccatttcttgttgactcgcgcgaagccttttgggcaaaactgtcgtcaataaggatgtcttcagagatcctgctcttaaacgcaaggcccgacgggaggccaaggtcaagtttgaagagagatacaagacaggcaagaacaagtggttcttccagaaactgcggtttactgcggttttagatgctttgttttgatcattaaaaattataaagacaaacacacaacattggcctctttggcctttgtggttt

SEQ ID NO: 431584 - DNA, 259 bp, Homo sapiens
  misc_feature (22)..(22): n is a, c, g, or t
gctactactactactaaattcncggccggtcgacgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggtttcacaaaagattttatcgtcgacgcggccgc

SEQ ID NO: 431585 - DNA, 834 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaacaaaaacaaaaacacacaaacaaaaaaaaaagaaacaaaaaaaaaaaaaaaaaaaaaagggggggggcaaaaaatacagggaggaccccagcacaagagcagaccccacacttgcggcgacaaaagggggcccactcaaaaagggcggcacgtgaacaaacaacaagacaagccgcgcgccgaacactagacacccgcggacggacagaaccagacgaacgcagggagcagcaggtggaggacacaaaatacgcggggagggaccacgagggcaacaacacacacacgaactgacaagcgcagcgcagaaaaga

SEQ ID NO: 431586 - DNA, 1414 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaaaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431587 - DNA, 890 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaactaaacacagcagaaaacaacacaaaaaacacgtgtgttgggcggccgcggggcctcgagaaaagttttcaaacaacaaactggttgggggcgcggggccccacgcgggcaacagcgcacacgcgggggctcaacagcggtggtcccccaaaagagaaaaccggcggggcagagaaacaaagcgggcccgcgggcgaattcctcacaccagttagaaacaacgcccgcgcggggaaccagcggaggcgtttcggaacacaaaaatccacagaaagagcggatccggagggacccatagcgcgggcccatcaacacggggtgtcccaaggggaactctgctaaatacaaagtaagccgcgcgcggggc

SEQ ID NO: 431588 - DNA, 554 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaaacagagaaacaccctggggggtcttcggggggggcgc

SEQ ID NO: 431589 - DNA, 789 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaagaaaaaaaaaaaaaaaggggcggcccggatacacactcgaattctttgaagatccgagtgtgattggacatcctgcgatttttcccccctgctaactgttacctctattttaattacggtataaataggttactattctgcgattccttactgactttgcatttcgctttttacacaggcgtgtctcacttcttacgcggtttacataacacttatttcccactggtcacaacaaaaacccacacacaaaacaaacacaaaaaaaaaac

SEQ ID NO: 431590 - DNA, 1149 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431591 - DNA, 908 bp, Homo sapiens
gcccttcaagggtatgagccccaggtatatgcccccctttgttgttgtgtttgtgtgtgtgttttgaagaatcggagcctgggtggcctaaaccacttgggggttcagatcctccgttttgtctaagattaagaaacggttcttcagaattttgttaagttgggggcaacccatataggccccccagttaatggaggttccttcaactattaggacttttcgcttcgaagcgaaggctttcctcagatgcatgaaaattgattaatattgactgcctgttagagaaatgaatgagcctacagatgataggatgtttcatgtggtgtatgcatcggggtagtccgagtaacgtcggggcattccggatagccgagaaagtgttgtgggaagaaagttagatttacgccgatgaatatgatagtgaaatggatttttgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431592 - DNA, 595 bp, Homo sapiens
  misc_feature (54)..(54): n is a, c, g, or t
  misc_feature (78)..(79): n is a, c, g, or t
  misc_feature (99)..(99): n is a, c, g, or t
aagagtggtatcaacacagagggcccattacggccgggaagagtggtatcaacncagagtgcccattacggccgggannagtggtatcaacgcagagtngccattacggccggggcctttttgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431593 - DNA, 476 bp, Homo sapiens
  misc_feature (1)..(1): n is a, c, g, or t
ngggcagcatggaatttgggcacgagccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431594 - DNA, 1227 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaaggtatcagcctcgcgggactctgcgtccttgcatgccgggaccaggctggctgcggcggggcgggcaggcttggaattcaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431595 - DNA, 1399 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaatggaagagacgcccctgctaacgggaatgctaatgaggaaaatggggagcaggaggctgacaatgaggtagacgaagaagaggaagaaggtggggaggaagaggatgaggaagaagaaggtgatggtgaggaagaggatggagatgaagatgaggaagctgaagtcagctacgggcagcgggcagtgaagatgatgaggatgacgatgtcgatacaagaagcgagacgagagatgatta

SEQ ID NO: 431596 - DNA, 1632 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaatctcgaaatctagttcctctacgaacgcatggtggccctcgggaaagtctggtggcgtgtgtccaaagtccgatcccagctggggctgtaaactggggcttgggcccccgcttaaaggccccgcacagaggcaaaacgggcaatcgccaaactggctacagcggagcgggagaaggccaagcaataggcccgggggggaaacactctctacaactaatggtgccccaaggtaacagctgggtgccaggaaccagaatcgagacagagcaagtcccggagaaaaggctaccaaaaaagagctgaacccacatgctcgtcggaaccacagggaaccggcagggtccggaaaaagctcactcggaactggcagccatcatgagggcgcatcaagctccgaggaaaacgggacctggaaaggctggaaacggaccaatcgccaactcacaagaaaagacgaaaaaga

SEQ ID NO: 431597 - DNA, 2046 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaaaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431598 - DNA, 1421 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaagaaaaaaaaaaaaaaaggggcggcccggatacacactcgaattctttgaagatccgagtgtgattggacatcctgcgatttttcccccctgctaactgttacctctattttaattacggtataaataggttactattctgcgattccttactgactttgcatttcgctttttacacaggcgtgtctcacttcttacgcggtttacataacacttatttcccactggtcacaacaaaaacccacacacaaaacaaacacaaaaaaaaaac

SEQ ID NO: 431599 - DNA, 1313 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaacaacaacaaaaaacccgcgggggcccggtcccatcgcccatagagagtatacaggcggggtacaagccggccggtaaccgtcgtcccataagcggagcacaccctcggggcgggacaggccgacgcccacaggggcagagacagagacagtacagaaggaactg

SEQ ID NO: 431600 - DNA, 2049 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaacaaaaaaaacaacaaaaaaacagaaaaaaaaaaaaaaaaaaaaaaaaaaaaaaaaaaaaaaaaaaaaaaaaaaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431601 - DNA, 994 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaagaaaatgattaaaaggcccattttgtgggaaactatgaggtcacccaccattttgggaagtgctgattcctcttcctttccaagttgccttaagaacctggggacacaagactt

SEQ ID NO: 431602 - DNA, 1133 bp, Homo sapiens
  misc_feature (1111)..(1111): n is a, c, g, or t
  misc_feature (1116)..(1116): n is a, c, g, or t
  misc_feature (1118)..(1118): n is a, c, g, or t
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaactgctnatcangncttgttgtcataata

SEQ ID NO: 431603 - DNA, 1619 bp, Homo sapiens
aaatgcagaagcctggttaatggcgagcttctctgtgcatcgcggttgggggtcgaagtccgggcggcgccggtgcattgcttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaacaaaaaaaacaacaaaaaaacagaaaaaaaaaaaaaaaaaaaaaaaaaaaaaaaaaaaaaaaaaaaaaaaaaaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431604 - DNA, 1137 bp, Homo sapiens
  misc_feature (1081)..(1081): n is a, c, g, or t
  misc_feature (1113)..(1113): n is a, c, g, or t
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagaggaggaggtaccaanggtcaaggcaatgtccaaagtgggttctttcnagaaaccttgtggttttttagggt

SEQ ID NO: 431605 - DNA, 1277 bp, Homo sapiens
gcggccgcctactactactactgctcgaattcaagcttctaacgatgtacggggacatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaaaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431606 - DNA, 1697 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggaccgacgggaggccaaggtcaagtttgaagagagatacaagacaggcaagaacaagtggttcttccagaaactgcggttttagatgctttgttttgatcattaaaaattataaagaaacaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431607 - DNA, 818 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggaccgacgggaggccaaggtcaagtttgaagagagatacaagacaggcaagaacaagtggttcttccagaaactgcggtttcacaaaagattttatcgtcgacgcggccgc

SEQ ID NO: 431608 - DNA, 716 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggtttactgcggttttagatgctttgttttgatcattaaaaattataaa

SEQ ID NO: 431609 - DNA, 511 bp, Homo sapiens
aacttgcaatgagctgagatcacaccactgcagtccagcctggacgaaagattcagactccgtctcaaaaaaaaaaaagtgtgaattttcagataatgtcatcgggacatggcttttgatggttgcttctaaggagtcagaccctgattccctagtgtcccacaaggatttgggctgtataggggccccggcagtatgtgggctaatcctgcctctccacctttgtcccaaggtactctgtggatatccccttggacaaaactgtcgtcaataaggatgtcttcagagatcctgctcttaaacgcaaggcccgacgggaggccaaggtcaagtttgaagagaggtaagtaggctttggtagtgaatggtggagtatggtttcactatttccattcctttcctcattggtgtcctctttttttcccttctagatacaagacaggcaagaacaagtggttcttccagaaactgcggttttagatgctttgttttgatcattaaaaattataaa

SEQ ID NO: 431610 - DNA, 524 bp, Homo sapiens
  misc_feature (26)..(26): n is a, c, g, or t
  misc_feature (31)..(31): n is a, c, g, or t
  misc_feature (36)..(36): n is a, c, g, or t
ccggccgcgcgacacggctgcgagangacgncaganggggagtgtccccctgctgtaggcccgggtggttgctgccgaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431611 - DNA, 333 bp, Homo sapiens
gcggccgcctactactactactgctcgaattcaagcttctaacgatgtacggggagaaatgggcaagttcatgaaacctgggaaggtggtgcttgtcctggctggacgctactccggacgcaaagctgtcatcgtgaagaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431612 - DNA, 767 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaatggaagagacgcccctgctaacgggaatgctaatgaggaaaatggggagcaggaggctgacaatgaggtagacgaagaagaggaagaaggtggggaggaagaggatgaggaagaagaaggtgatggtgaggaagaggatggagatgaagatgaggaagctgaagtcagctacgggcagcgggcagtgaagatgatgaggatgacgatgtcgatacaagaagcgagacgagagatgatta

SEQ ID NO: 431613 - DNA, 1392 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaacaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431614 - DNA, 876 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaa

SEQ ID NO: 431615 - DNA, 1348 bp, Homo sapiens
tcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggtttactgcggttttagatgctttgttttgatcattaaaaattataaaaaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431616 - DNA, 1411 bp, Homo sapiens
  misc_feature (1156)..(1156): n is a, c, g, or t
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagagaaanagaagaactagtctcgagttttttttttttttttttctcatttaacttttaaaggggtctcaaaattcggggacaaattttgggtcaacgtgggttcccattaaaaggtacgggttttaaaaactaataccttaaaagtgcacacgcaaaaaagaaagaccaagggggtccacaaaacattctcctttccttctgaaggtccacgaggcatggtatcattaaccagtctttactactaaacttaagtgggcactg

SEQ ID NO: 431617 - DNA, 2024 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaacaaaaaaaaaaaaaaaaaaaaaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431618 - DNA, 1997 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaaaaaaaaaaaaaacaaaaaaaaaaaaataaaaaaaaaaaaaaaaaaaaaaaaaaaaaaacggggggggaatccaatggcgcgggggcgcgcggaaaaacggggtcacgcaaagtgggccaatgggccaaaaggcagtgtacccgagaacccaagtttcctgggtgcacaaaggggcgacaaaatctgcgcaggagacacaccctataaagagaagagcgcatatatacacttccgaaataacgcacggggttacccgggcttatgaatcccgtcgaaacaaaaccaagacaccaacaaccaaacaccacacaaaaaaccacccgcggacgaccaccaacaacgacaacgaccacaaaacaagatgacgacaacagaaccaaagcacacaaacacacaacacacaacccacccaccgaaaacacccgcaccacacacgcaacccaacaacaaaactacacacaacacacaacactacacaggatcaagccaacgaccaactgagagaagcatcacaagcagccaacaagcacaacagcggccaccgcagacacgaagagaagcacgagcgacgggcagagcagctgaggacaccaacctagaggaaaaacaacgaagaagatagcgccaggcgcgaggacaagacgagacggagaaaggaagaaaaagagaaaagaaagacgacgacacgacgaacacgcagaacagaagcaggagggaggaagaccaaggaaaccacgaaaagcaaaagacgaagcgagaaggagcgaagacaaggggcgacggaagaagccagagggagacgcgcgcacgacacacgaaacacgagcgagacggagagaagaagatga

SEQ ID NO: 431619 - DNA, 1069 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaaaaaaaaaaaaaacaaaaaaaaaaaaattcgggggtttatttgttgggggggggaaaaaggggtattggaatgggcccttgggttctatagcttgtttcctgacccaagttttttgtgtacaagggggaaattcggcggggcccccaaaagggaggggcgataaatttgaaaaggcgggttaccgggtagaaga

SEQ ID NO: 431620 - DNA, 1091 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggaccgacgggaggccaaggtcaagtttgaagagagatacaagacaggcaagaacaagtggttcttccagaaactgcggtttcacaaaagattttatcgtcgacgcggccgc

SEQ ID NO: 431621 - DNA, 834 bp, Homo sapiens
  misc_feature (822)..(822): n is a, c, g, or t
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaagaaatgggcaagttcatgaaacctgggaaggtggtgcttgtcctggctggacgctactccggacgcaaagctgtcatcgtgaagaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaactgtgtcaataagatgcttcagggtctctctaacgaaggccgcggcgcaggcagttgagagtcagcagcagccagtgtctcagactcggttagtctttttacataattntaaaaaaaaacc

SEQ ID NO: 431622 - DNA, 1209 bp, Homo sapiens
ggcacgagctggctctttaatgggaaatgggaggaagggctgtccgcacaggaatggggttaggctgtcagaagcgcagccccctgcgggctaagtcggctcgggcctcctgtatctggctctgcagctcgcgtgcggcgtcctcgcagtcatgaaaagtggccacacgatagcccacagtgcccagggcatagcagccggcggacaccagcaagtaggcgggcagtggccacaggacttcctggcaggacaagggcagctccaggcccaaggctcccgtggtcagggccacccaggtggagcccaggatcgctagtccccaaagccactgcgctaatttcgtcatggtcactgcgagagaaggaagcaatgctcccctctaccccacgtctccccttccccgcgcggcccgggtggttgctgccgaaagtagaagcttgggttgaatctttcaatctgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaacaaaaaaaacaacaaaaaaacagaaaaaaaaaaaaaaaaaaaaaaaaaaaaaaaaaaaaaaaaaaaaaaaaaaagaaaaagaaaaaagaaggagagagagaaaaggaggaagcgaaaacacgaagcaaagacagacggacaaaagagcaaaaaaaaaagaccgcggagagaaaaaggagacgcacaacgaaagagaagggggggaggaaaagaaacaaacag

SEQ ID NO: 431623 - DNA, 2566 bp, Homo sapiens
ctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatt

SEQ ID NO: 431624 - DNA, 2263 bp, Homo sapiens
ctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtctta

SEQ ID NO: 431625 - DNA, 1613 bp, Homo sapiens
ggcgtgggggggggcagaagcaggaagcaggcagaagcaggaagcaggcagaagcaggaagcagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtctta

SEQ ID NO: 431626 - DNA, 1091 bp, Homo sapiens
caattccatctagggcgctctgaatgcctttatttcattcctttttatggctgagtagtattccacggtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtctta

SEQ ID NO: 431627 - DNA, 2876 bp, Homo sapiens
ctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatttttgtagtagtcttctgcattttacttcaattataaattgcaattatttattggatattttggacttcaaagcagcagaaactttaaaactgaaatgggaaacgttttcctgcaatgatccctgtgctgtaacattttgtctggtgtctcaggcttccaggttcttgttggcctgaattcccttgttgcccagtaaatgttcactagctagaagtatcttcaggaagtgagatagaaaagagtgaacctcaacaattggactggaaatgagctttgacctaactttgtaaaataaaagcataaaagagaa

SEQ ID NO: 431628 - DNA, 2838 bp, Homo sapiens
ctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttaaaaaaaaaaaaaaaaaaaaaaaaaaaaaaaaaaaaaaaaaaaaaaaaaaaaaaaaaaaaaaaaaaaaaaaaacagaggacgcgacacaccaaaccccacaaaaaaaaaaaacaaaccgcaaaaaaacaaggacccaacaatgacacgagcacgccactactccactacacccacaacgaccaacccagccacacacccatcaacaacaccccacgacacgccccgcagagaaccacaccgccgccacacacgccaggcaacactccccgcacagagaccgacaaccatcaacccagcgaggccacgcgtcaccaccaccaacccggccacccaccaaacccaccacccacaccccggccgccactacaccgccccccacacggacgcacaacccaacaccacacacatagcagccccccacacacaccacgccaacaacccccagccgccaccagccgccgcccgcgccgccaaccagacgacaatcgcgcgcgccccacactcggccgacatgccacacccagacaacaacacgacaccacagcacacgaaacccacaaaaacaaccgccccca

SEQ ID NO: 431629 - DNA, 2318 bp, Homo sapiens
ctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaatttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaatttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttataccaaaaagaaccatttggccatgatttttataaaaaccttcagggggggccct

SEQ ID NO: 431630 - DNA, 521 bp, Homo sapiens
ttgaggcacatttcctgtcccctggcaactctgtgtgtaacgtttcaaacccaaggcattgtacaagggagaggagtactttgggtttacatggttgagggtgatgatgaatcctcttatttcatgtgtaagaagaccgggttatttgttgccatgccccacactgatgctggggccaaggcaagcaaaaggggacgcctaagtcctagcctaatgtctgtcttctgtagagcaagctgaactttcaaaggtatttctcgttttacctgttttgtaaatgaatatgctaactttgcacgccgcagaggaatgtgagatatagagagcaggccgaggtccatggggcttcataaagggcattttgagcagctggaggcttgtggttaccatgtccaggctcttcccctgctctccttaactatcctacagatgcctctgacctgggaggaaggaagagaagccctcatctcctgactgagagtgggaagtggcagtcactaaatgtgctgacgtgtgacatt

SEQ ID NO: 431631 - DNA, 1420 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431632 - DNA, 1361 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431633 - DNA, 1555 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431634 - DNA, 1644 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggtgaggggagggcctctagcagggcggcgatcggcttggggcgcgcggctccgcggccgctagtgctccagctcgcgctccgccctcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431635 - DNA, 1675 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtgcgtggttagtgatcccagtttggagggcgttactcccaggcggggctgggggagtaggggaagttcgatgcccccaggtgaaaggacgtgctcctccctgacccgctccgcccgcaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431636 - DNA, 1898 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtgcgtggttagtgatcccagtttggagggcgttactcccaggcggggctgggggagtaggggaagttcgatgcccccaggtgaaaggacgtgctcctccctgacccgctccgcccgcaggcgtgtgccaggtgttcgccgaggcgctgcaggcctatggggtgcgctttacgcgactgccgctggagcgcggtgtgggtggctgcacttggctggaggcccccgcgcgtgccttcgcctgcgccgtggagcgcgacgcccgggccgccgtgggccccttctcccgccacggcctgcgggtgaggctccccgccccgtctcctaccatagctgcctctgtccctccgcactggctgttcacctggctagctgtgtccgtttctcaacccggaagcgagtctggcgtcgaccgctgccgccaccccagttaccccctcccaccccgccgtcccttccctagcctacctagcccttggccatggcccggcctggtcccacctctgatgtcccgccccccacaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431637 - DNA, 1377 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431638 - DNA, 1466 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggtgaggggagggcctctagcagggcggcgatcggcttggggcgcgcggctccgcggccgctagtgctccagctcgcgctccgccctcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431639 - DNA, 1183 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgcaggcaggcctagcctgtggcagcgggctagggcccgcagagcatttggtgcccctccatgttgcaatgcaaacaccttcaccactggggcagtggggagagatggctatattaataaaataacgtgtgtctttcaaaaaag

SEQ ID NO: 431640 - DNA, 873 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtactgtgaggccgttaggagctggcggtggatgacttccgcattcaaacactggagccatcacacggaagcacgaggagggtatcctcggcagctactcccggtcgctcaaggtgtctctcgctcgccctctaggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggcaaaccggcgactgatggcacccggaacccaggggccccacgggggggggaagccccccacacatgcccggaagacgccgaggcaacaggccggccc

SEQ ID NO: 431641 - DNA, 1109 bp, Homo sapiens
ggcctgggctgtccggcccactcccctgggagcgcgagcggtggacccaggcggccatgtcccgccctcgcatgcgcctggtggtcaccgcggacgactttggttactgcccgcgacgcgatgagggtatcgtggaggcctttctggccggggctgtgaccagcgtgtccctgctggtcaacggtgcggccacggagagcgcggcggagctggcccgcaggcacagcatccccacgggcctccacgccaacctgtccgagggccgccccgtgggtccggcccgccgtggcgcctcatcgctgctcggcccggaaggcttcttccttggcaagatgggattccgggaggcggtggcggccggagacgtggatttgcctcaggtgcggagccgcagctacaggaggatgctcgcgaggacccccagagctccgcccggagggtgcgggaggagctcgaggcccaactaagctgcttccgggagctgctgggcagggcccccacgcacgcggacgggcaccagcacgtgcacgtgctcccaggtggacagacgccttcgtgggcctgagcacttgcggccggcacatgtccgctcaccgcgtgtccggggccctggcgcgggtcctggaaggtaccctagcgggccacaccctgacagccgagctgatggcgcaccccggctaccccagtgtgcctcccaccggcggctgcggtgaaggccccgacgctttctcttgctcttgggagcggctgcatgagctgcgcgtcctcaccgcgcccacgctgcgggcccagcttgcccaggatggcgtgcagctttgcgccctcgacgacctggactccaagaggccaggggaggaggtcccctgtgagcccactctggaacccttcctggaaccctccctactctgaccctaagaaacaagatatccctagtacagaagggacagaatatcctggcagcaagtggctgacacgacgtgataccggtgacgccctggcagccctgccaaggtaattggacctggggagcaacgggggagccaatggcctggaccggggggggttaaggttcaaaaccttggggggtctctcattttgtagtaggtcac

SEQ ID NO: 431642 - DNA, 3443 bp, Homo sapiens
  misc_feature (1606)..(1606): n is a, c, g, or t
aagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagtggtgcagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcantgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaatgaaatacaaagatttccttctttgactatttaggaaagactaagcaaccaaatagcaaagatccctcaggataatgaggtttatgtttggaatagcatgagcagattactacttaggacacagattcctaggaacattcctcattgaaaataaaatggattcctgggaaataggtaactagaaattttggccagaaatggtttcatatgaagaactgagaatgcgtgggaagtatagagggcaagtgggcttattttcatatatgcaaagcaatattaaggaactctattttcatgttttagttcttcccctcatgt

SEQ ID NO: 431643 - DNA, 3366 bp, Homo sapiens
  misc_feature (1529)..(1529): n is a, c, g, or t
aagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccagcagctcaggacctcagcaccctgctgtgcctggaggagagcatggaagagcaggatgagaagcccccagagcccccgaaggtctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttgcaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatcctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcantgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaatgaaatacaaagatttccttctttgactatttaggaaagactaagcaaccaaatagcaaagatccctcaggataatgaggtttatgtttggaatagcatgagcagattactacttaggacacagattcctaggaacattcctcattgaaaataaaatggattcctgggaaataggtaactagaaattttggccagaaatggtttcatatgaagaactgagaatgcgtgggaagtatagagggcaagtgggcttattttcatatatgcaaagcaatattaaggaactctattttcatgttttagttcttcccctcatgt

SEQ ID NO: 431644 - DNA, 3830 bp, Homo sapiens
agtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 431645 - DNA, 237 bp, Homo sapiens
  misc_feature (4)..(4): n is a, c, g, or t
  misc_feature (13)..(13): n is a, c, g, or t
  misc_feature (34)..(34): n is a, c, g, or t
  misc_feature (45)..(45): n is a, c, g, or t
  misc_feature (61)..(61): n is a, c, g, or t
  misc_feature (69)..(69): n is a, c, g, or t
  misc_feature (73)..(73): n is a, c, g, or t
  misc_feature (79)..(79): n is a, c, g, or t
aganagaaacaanaggatgtatagtgccttctancagcagacctntttttctctctctctntctctctntctntctctntctctctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 431646 - DNA, 3524 bp, Homo sapiens
atattaaagaactaaccggttaaataaagacctatgaaaacccagcagagtctacggaaggtttagttctaaccatgcctttgtgtgggtacttcagcaggttaccttcagttatggagtctgtaatactctgtgtaagaatcatttcaatccatgctttgtttttgagcccaaaccttgctccttctacccccgcccaccagcccccaaccaattgagaaagggaaaaagataaggaccaaaaaacagaatattttaagttcagctgaaattccacctcctctacaaggttctttggacttgttatccagcaggcatttctcccggccatgagatcttgctgcggtggccctgccctcccctctgactcgcatgttgtctgccttatagtagacatgccgtgttgatctttgcgcagaacgcctgcattaggactgtgcttcttcctgctaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 431647 - DNA, 1808 bp, Homo sapiens
acttctccagtcagattaaaacttgagagaagtaacacactcaataatagagaaaaacatagcagtgacctaatgtgtcaagtattgagagaagtttgcaggggtgggattctcttgcacatgtgaactgcaaaatgtttttttgagctgcaaattttaagtagacatttctttctctcttacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 431648 - DNA, 422 bp, Homo sapiens
gctggtcaacaacctggccgagatctatggccggatcgagcgggagcaccagatctcacctggggacttccccaatctgaagaggatgcaggtagcgagggctggggtctctaagacaagggacagtgtcccgagagctggctgagcagcctgagtatggaggaggccactcttggagccccccagggagaaccccgcccagaatctgcaggcaaggaggtggccctggatctacactcctagctgggccatcactggcccaacaggggccatgtctgggcctggggagaaacacggagcccaccgccccagtggtgcaggtgtgttagatgatgctggggggctgacacctccagttaatgaccttctctagtcacagccaccacaggcttgacgtccccaccatctctggtgcagtggga

SEQ ID NO: 431649 - DNA, 1430 bp, Homo sapiens
agtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtgagccggcccagggtcctggcagcccaccccggagcccagcgcctagtccctccggtcactcctggtgctccatcccagacaggggaccaatgggaagccctcagttgagggctctgaagagatctgtgtttgtgcaggcgtcaaaatcttaccccacaatttttgctggtcccccttcccatcctacccaatacctgtccactctacttggcccttggctgtggtggtcaacctgaagtattcaagtgtaaagccattcccagtctccccatcttatggatgatgaaaccgaggcccaggaggcacaatggaagagctcctggtctctggagcgccttatgttggtggggatgtcttacgtcttcactttttagcaacacatcattcacgggcaaaacctcttcccttgtttttcaaggggcttggcactcacatgggggcctcacagttgcagctgagttctgatgggtgcgggcctgggaacggaggtggcctggggatgctacttgtcctccttttatcatttccttctctaaagcagagctcctgtgtatatatcttggagactcaacagaagctgagtccagaagcagaatgctttttttttcccctttctcttatttgatcttaatggcttaataataatattaaagacgcttagagatgga

SEQ ID NO: 431650 - DNA, 3777 bp, Homo sapiens
agtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccacgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtgggccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 431651 - DNA, 2116 bp, Homo sapiens
agtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacggctccttcttcctctacagcccgcctatccaattgacaagagcaggtgtcaccgagggcgcatgtcttctcatgccccccgatgca

SEQ ID NO: 431652 - DNA, 845 bp, Homo sapiens
tccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcagaggttgcagtggggcaagattgtgcgattgcactccagtctgggcaacaagagcaaaactctgtctcaaaaaaaaaaaagtttgttagattatttgtgaacttaattttattttatttttaccatggtaagactaccgtgcgtttaatgaaccattattgtgccactaactgtatcccactttactcaagggtgtaggtacaatattgtaggaatatactatttcatacattgtaaaataacatctttagtaatcactgtcagtggctttaaactgcaaatgagttaaatattgttcccatagattaaattttgactctttattatttaaattttttatttgtattcgtgggtatataatatgtgtatatatttatgccttatatggcatcttttgactcaggcctacaatatgtagtaattacattatggtaaataaggtatccatcacctctagcatttatcttttgtattaccaatagtgtaattatatgcttttattcattttaaaatgtacaattaaattgttattgactacagaaaaattt

SEQ ID NO: 431653 - DNA, 2713 bp, Homo sapiens
  misc_feature (2319)..(2321): n is a, c, g, or t
  misc_feature (2326)..(2326): n is a, c, g, or t
  misc_feature (2340)..(2340): n is a, c, g, or t
  misc_feature (2343)..(2343): n is a, c, g, or t
  misc_feature (2353)..(2353): n is a, c, g, or t
  misc_feature (2359)..(2361): n is a, c, g, or t
  misc_feature (2376)..(2377): n is a, c, g, or t
  misc_feature (2394)..(2394): n is a, c, g, or t
  misc_feature (2396)..(2396): n is a, c, g, or t
  misc_feature (2398)..(2399): n is a, c, g, or t
  misc_feature (2409)..(2409): n is a, c, g, or t
  misc_feature (2414)..(2414): n is a, c, g, or t
  misc_feature (2417)..(2417): n is a, c, g, or t
  misc_feature (2420)..(2420): n is a, c, g, or t
  misc_feature (2433)..(2433): n is a, c, g, or t
  misc_feature (2438)..(2439): n is a, c, g, or t
  misc_feature (2441)..(2442): n is a, c, g, or t
  misc_feature (2445)..(2445): n is a, c, g, or t
  misc_feature (2451)..(2451): n is a, c, g, or t
  misc_feature (2454)..(2454): n is a, c, g, or t
  misc_feature (2461)..(2461): n is a, c, g, or t
  misc_feature (2482)..(2482): n is a, c, g, or t
  misc_feature (2487)..(2488): n is a, c, g, or t
  misc_feature (2496)..(2496): n is a, c, g, or t
  misc_feature (2498)..(2498): n is a, c, g, or t
  misc_feature (2510)..(2510): n is a, c, g, or t
  misc_feature (2512)..(2512): n is a, c, g, or t
  misc_feature (2520)..(2520): n is a, c, g, or t
  misc_feature (2527)..(2527): n is a, c, g, or t
  misc_feature (2542)..(2544): n is a, c, g, or t
  misc_feature (2567)..(2567): n is a, c, g, or t
  misc_feature (2576)..(2576): n is a, c, g, or t
  misc_feature (2578)..(2578): n is a, c, g, or t
  misc_feature (2584)..(2585): n is a, c, g, or t
  misc_feature (2607)..(2608): n is a, c, g, or t
  misc_feature (2623)..(2623): n is a, c, g, or t
  misc_feature (2629)..(2630): n is a, c, g, or t
  misc_feature (2632)..(2632): n is a, c, g, or t
  misc_feature (2635)..(2635): n is a, c, g, or t
  misc_feature (2639)..(2639): n is a, c, g, or t
  misc_feature (2646)..(2647): n is a, c, g, or t
  misc_feature (2651)..(2652): n is a, c, g, or t
  misc_feature (2670)..(2671): n is a, c, g, or t
  misc_feature (2676)..(2676): n is a, c, g, or t
  misc_feature (2693)..(2693): n is a, c, g, or t
  misc_feature (2700)..(2700): n is a, c, g, or t
  misc_feature (2708)..(2708): n is a, c, g, or t
tccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcgaaggctttaagtgcccctctacccttactacacataaggtaattcatactggagagaaactataaatgtgaggaatgtggcaaagctttaagctatcccactatgcttttttcacataagaaaattcatattggagggaaactgtacaagtgtgataaatgtggcaaagcctttatttcatcctcaaaccttagtagacattagataattcatgcgggaaagaaacccaacaaataagaaaatgcagcaaagcctttaaggacacctctgcccttactagacataagataattcgtactggagagaaaccctgtgagtctgatgaatgtgggaaagcctttaaccagctatcaacttttactaaatatgagaatttatatggaacataaaccctacaaatataaagaatgtgacaacgcttttaggaagttctgaacccttcttacacataattcatgctggacaaaaatcctacaagtttgaggaatgtggcaaatcctataacaagttttcaatatttttttttttgagatgaagtttcatgcttgtcatccaagctggagtacagtgccatgatctcggctcactgcaacctctgcctcctgggtttaagccattctcctacctcagaggctgaggcaggagaatnnnttgancccaggaggcagangtngcagtgagcngagatnnngccactgcactccannctggcgacagagtgagncncnntctcaaaaanaaaanaanaanaaaaaaaaaaaanaggcnngnngcngtggcncangcctgtnatcccagcactttgggaggcngaggnnggtggatnangaggtcaggagntngagaccancctggcnaacatggtgaaaccnnntctctactaaaaatacaaaaatnagccgggcntngtggcnngcacctgtagtcccagctactnnggaggctgaggcagnagaatnncntgnaccnaggaggnngagnntgcagtgagccgagatcnngccantgcactccagcctgggngacagangagactcngtctc

SEQ ID NO: 431654 - DNA, 869 bp, Homo sapiens
tgcacacgccgagaatcatactcgtcttacctttcgggagcgaacctcaacctctcctgccactcggcctctcaaagtgctggattacaggcatgagccaccatgcttgacctgtttattgttaaagtagcaatagcacgacgtgctttcctaggacctgctggcctgtttttcactgatataaagtgaaggaggcattgaaatagcagaggcaggtgatataaattgaatacttatatgaaataaaattttaaataaaaattagcatttgatgttgtacaactataggtgagactattagtgtgaggtcatatttttacttatattgacaaaataaccattcacaatattcttatttagaacaattttccttttctactgtgcttttgctagcttttgatcaaatattacaggaactcaatagaaatcaacaaaattaatctttattttactagaagggttactgatgcatatgctaattttttttcagttttttgtttattgcagagaagtggctgtcctactagaaaactgctactctcatctgtatccacattgaataatagtgaatggaagtgaagcggataaaaggtaaatgtgtcttctctgtatcttttttcatccattggctgaagaacaggaaaatgtggaaaataaaagaaaatataacccctgaaaaatcctgaagaagctctcttaaccagacaaaaaaccttataggggattttttgtttgttttattattgtaccatctgcttctatgagtttaattttttttttttttttacactttacatagaaataggattatgtgggctgggcacagggactgacgcctgtaatcccaacacttggaggggctgaggtgg

SEQ ID NO: 431655 - DNA, 2947 bp, Homo sapiens
tccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcgaaggctttaagtgcccctctacccttactacacataaggtaattcatactggagagaaactataaatgtgaggaatgtggcaaagctttaagctatcccactatgcttttttcacataagaaaattcatattggagggaaactgtacaagtgtgataaatgtggcaaagcctttatttcatcctcaaaccttagtagacattagataattcatgcgggaaagaaacccaacaaataagaaaatgcagcaaagcctttaaggacacctctgcccttactagacataagataattcgtactggagagaaaccctgtgagtctgatgaatgtgggaaagcctttaaccagctatcaacttttactaaatatgagaatttatatggaacataaaccctacaaatataaagaatgtgacaacgcttttaggaagttctgaacccttcttacacataattcatgctggacaaaaatcctacaagtttgaggaatgtggcaaatcctataacaagttttcaatatttttttttttgagatgaagtttcatgcttgtcatccaagctggagtacagtgccatgatctcggctcactgcaacctctgcctcctgggtttaagccattctcctacctcagcttcctgagtagctgggattacaggtgtcctccaacatgcccagctaatttttttatttttagtagagatgcgacttcgccatgtttgccaggctggtctcgaactcctgacctcaggtgatccacccaccttggcctcctaaagtgctgggattacaggcgtgagccacgacgcccagccacaagttctcaattcttaagaggcatggcaataattcatgttgaagaggaaatccgcaaagctaaaaaatgtgacattgcttttacgaacacctccaacttctctacacataacaataattatactagtgtgaaaccctagaaatatataaaatgtgacaaagcctttatatggttgccactcttgattgtaggttggataattcatactggcaaaactcctacaagtgtgaagaatgtggcaaaacttttaatcagttcttacaccttatctcacagaaaagctagtatccttgagaaaaattgtacaaatagaaggaatatgggaaaacctattaattcctactcacatctaactcaacataaaaatcttccttttaataaaaggcatttaaaatgggcaattactgtcaaaactttcagcaagtataaggccttttaaagtggaggagggagtatttattgtg

SEQ ID NO: 431656 - DNA, 2820 bp, Homo sapiens
tccaggtcttgtcttcactgctgtgtgtcctctgctcctagaggcccagcctctgtggccctgtgtcctgcaggtattgggagatccacagctaagacgcccgggagcccctggaagcctagaaatggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcgaaggctttaagtgcccctctacccttactacacataaggtaattcatactggagagaaactataaatgtgaggaatgtggcaaagctttaagctatcccactatgcttttttcacataagaaaattcatattggagggaaactgtacaagtgtgataaatgtggcaaagcctttatttcatcctcaaaccttagtagacattagataattcatgcgggaaagaaacccaacaaataagaaaatgcagcaaagcctttaaggacacctctgcccttactagacataagataattcgtactggagagaaaccctgtgagtctgatgaatgtgggaaagcctttaaccagctatcaacttttactaaatatgagaatttatatggaacataaaccctacaaatataaagaatgtgacaacgcttttaggaagttctgaacccttcttacacataattcatgctggacaaaaatcctacaagtttgaggaatgtggcaaatcctataacaagttttcaatatttttttttttgagatgaagtttcatgcttgtcatccaagctggagtacagtgccatgatctcggctcactgcaacctctgcctcctgggtttaagccattctcctacctcagcttcctgagtagctgggattacaggtgtcctccaacatgcccagctaatttttttatttttagtagagatgcgacttcgccatgtttgccaggctggtctcgaactcctgacctcaggtgatccacccaccttggcctcctaaagtgctgggattacaggcgtgagccacgacgcccagccacaagttctcaattcttaagaggcatggcaataattcatgttgaagaggaaatccgcaaagctaaaaaatgtgacattgcttttacgaacacctccaacttctctacacataacaataattatactagtgtgaaaccctagaaatatataaaatgtgacaaagcctttatatggttgccactcttgattgtaggttggataattcatactggcaaaactcctacaagtgtgaagaatgtggcaaaacttttaatcagttcttacaccttatctcacagaaaagctagtatccttgagaaaaattgtacaaatagaaggaatatgggaaaacctattaattcctactcacatctaactcaacataaaaatcttccttttaataaaaggcatttaaaatgggcaattactgtcaaaactttcagcaagtataaggccttttaaagtggaggagggagtatttattgtg

SEQ ID NO: 431657 - DNA, 2087 bp, Homo sapiens
tccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcgaaggctttaagtgcccctctacccttactacacataagttttttgtttattgcagagaagtggctgtcctactagaaaactgctactctcatctgtatccacattgaataatagtgaatggaagtgaagcggataaaaggtaaatgtgtcttctctgtatcttttttcatccattggctgaagaacaggaaaatgtggaaaataaaagaaaatataacccctgaaaaatcctgaagaagctctcttaaccagacaaaaaaccttataggggattttttgtttgttttattattgtaccatctgcttctatgagtttaattttttttttttttttacactttacatagaaataggattatgtgggctgggcacagggactgacgcctgtaatcccaacacttggaggggctgaggtgg

SEQ ID NO: 431658 - DNA, 682 bp, Homo sapiens
tccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcaggtaggtgcaagtgaaaatgaatatagcagacgacacagataagaggtcccaaagtcaaagagaaagccagtccttaaagtgtgatttgggaagctgtgctccaaagaaaatagttcctgggagctgttttttttttttttttcttttttaaattttgctctatataaaggggcatcttctgcttatgcttttaaattctgtaaaaattctacttttctttcggtgagctcccttcaagttcacagtgagagccagagtcctcttcatggcatataaaatactgcacagtctggctgctttttcattgttttggggacacacaaatatctgca

SEQ ID NO: 431659 - DNA, 1988 bp, Homo sapiens
  misc_feature (418)..(418): n is a, c, g, or t
  misc_feature (1278)..(1278): n is a, c, g, or t
  misc_feature (1318)..(1318): n is a, c, g, or t
gactggatgtgagggtctgatggttttctctgatatgctttgacgtgcttggatgaaggaaggaatacgaatactcattcttccttccctaactcctcgtacggggccatatcagaattctagaattcttgccactgtgattcaattgctaacctaaagtcttctctttttacaaattcacctgcttcagtatatattaaggtggctttcgagaggcaagatgcttatttaaaagttaagcgtgaatctgtaaaattaaggttggttgcgtaaagttgaagttaaccacatgtaagaaaggaaaacttccattagttttcttcttagggtgtgagaattttacctaggcacatggatattgggctgaaaaaaaaaaaccgacatttttatttaaaactacatgtaaaaaatcatgaangattcagtaattatgttaggctcacaagtgaccattgagtttgcccctgtactgcttcccagcttttgtggtgttgaacttttctgttcttccaatagggagatacataatcaaaatacacacgaagacgagatagcaggcactcagttctaggccagtttctcagtttcctttgggcctgcctttattttgatagtcgcagaatgcaggttcagatgcgatccggtgcattctgggtggtatccccatagacagaatacaagttcaagactcatttttatgtccatttttatagtggtagactgtatgtaatagaccagatggttcattccaaatacatgacttggtcttactgctatatatgaaggaagtttgaaaatgtaatggggacaaaagccgtgcgtgacttcggtatacccagacttcattcagatttcttaaaaatctgctagggatgtctgttgaccagacgttggaaaacctttggtgtcagggagagtagaggagaagttctgattttcataaccctggtttcttatctaggcctgtttccttgcgtgaaaacatacatcaccaagtaatttgtagtacaaagaacaagagaagaaaccctaagaagatagcttatttgttatcctcccttttaatgactaaccttaatccaaatgaatccactgagaaccagcctgtggatgcctactgggctttcaccctggaccaggaatttttgacgtatgcctgtgttgaaggcactggatgcttgttttgtggaagacatgttcattgaggtaagtggctcatcgcttggtgtgtttggctctctttggcattatgcatagccaaggtcccagattttggcngctctcagtgggtgttcttgcatcagaactttaaaaaaantaacactaccttaacactgagactgtcaggtatttgtcagtatttatttctaatttcctactttaaatcttaggagacaaagtgtttctccaactggacgctgatttgaaacacaactagaatgctacaggtctctcttccagtatgcagctgctgtacctgaaaatttttccccataatttcccatctttagggtatgtccctgttatcaggtgtggaattaatgtgggtaaatttccatttcagttgaatttcctgtcatccccagcaaaacctgtgaatccttcttcaaagcatagaggaggcagagacaagtcttaaaccggcttcccttcgcttttaccaggtagcctggttcagtcccagctgggtcctgaaggagcacagtactagagcctgagtcatgttgactattaataaagtgcattaagtttgggtcaggcaaagtggtggcaaaagttcatgatgcaggacagaggaaacaagtggacaagacaagtggagcccagctctgttcgcatgggaggccgggcgatgctggcatgggtgtggttggccgagttctcatagctagagaaaggccgtgtaggtataagtgcttaatgtttcatctgtctgaaagaccagctatttgataatctttccgattaaatttctaaaattgctactt

SEQ ID NO: 431660 - DNA, 1031 bp, Homo sapiens
  misc_feature (1022)..(1027): n is a, c, g, or t
  misc_feature (1029)..(1031): n is a, c, g, or t
cctttctgctcttcactgggggtgttgcaatgagttggacatgttcctcaccattaaggggcttccactttagtgggaaagtcatatagaaacataagaaactctgatttgtaaatttagagacacacagtaggacaggagactgaaaaagcagagatttatttgactaggaaaacaaggcaaatcagctggagggggcaagatttgagtaggcatttgagaataggcagcctgctgagaggtaaagatgcagactccatcagtgagggtcctagcaggaaacagatggcacattcaaacagaataattaaggagaattgaaggaggggctgttttcaaggagaagctgtttacaatgttgtaggcaggattaaggacaaccaacaaggccttgtgctatactctagggcgggcaaccatggagagccatttacccccttggcctgtaggggcaagaggagaaagtggttatgggacccagagagagggactgtatggaggggatttcctggcagcagctgtggctctcagcaagggaagcagccaggctacagccacctgaccagaagggaaccaggagagtaaattccatgttgtcattctctctgcctgccagtctcctgccagtgcttcccatttggtggatccaactgaagtcacaaaacaaaggaacctgttgatgcaatccatagatagccagcctcccaaggacacagagcagggtggggagtggacctgcattagcaagcagagaatgtccagagcctagagacagccagcccatgcagagggtagggcataagccaggcagtggagagggtgaggagtggtgtatagaagagagcatggagtttaaggggttattatggctgagatccagaccatgagcagagaaaagttcagtttatctcacggaaaactttaatgttaggcttaatcctctgttccttcctccctacattcttcccaccttcccttccttctgtccttttcttctctcaataaatatttgttgaatgctnnnnnnannn

SEQ ID NO: 431661 - DNA, 859 bp, Homo sapiens
gagtcgtcggggtttcctgcttcaacagtgcttggacggaacccggcgctcgtcccgcacccgggccggccgtccatagccagccctccgtcacctcttcaccgcaccctcggactgccccagggcccccgccgccgctccagcgccgcgcagccaccgccgccgccaccgccgcctctgcttagtcgccgccatgacgaccgcgtccgcctcgcaggtgcgccagaactcccaccaggactcagaggccgccataaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatggagctgcagaaccaactaggtggctgaatcttccttcaggatatcaagaaaccagactgtgatgactgggagagcaggctgaatgcgacggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgatcaagtgaccaacttgcgcaagatgggagcacccgaatctggcttggcagaatatctttttgacaagcacatcctgggagacagtgataatgaaagctaagcctcgggctaatttccccatagccgtggggtgacttccctggtcaccaaggcagtgcatgcatgttggggtttcctttaccttttctataagtgtaccaaaacatccacttaa

SEQ ID NO: 431662 - DNA, 634 bp, Homo sapiens
tacagatagaaccgaggtgatacccctagttttagaagtttcaatagcatgttccctcgcctcctacgtttacctgtccatgtcttactactttgaccgcgatgatgtggctttgaagaactttgccaaatactttcttcaccaatctcatgaggagagggaacatgctgagaaactgatggagctgcagaaccaactaggtggctgaatcttccttcaggatatcaagaaaccagactgtgatgactgggagagcaggctgaatgcgacggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgatcaagtgaccaacttgcgcaagatgggagcacccgaatctggcttggcagaatatctttttgacaagcacatcctgggagacagtgataatgaaagctaagcctcgggctaatttccccatagccgtggggtgacttccctggtcaccaaggcagtgcatgcatgttggggtttcctttaccttttctataagtgtaccaaaacatccacttaa

SEQ ID NO: 431663 - DNA, 573 bp, Homo sapiens
aatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431664 - DNA, 1286 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431665 - DNA, 435 bp, Homo sapiens
  misc_feature (22)..(22): n is a, c, g, or t
tagtggatcccccgggctgcangattcgccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431666 - DNA, 364 bp, Homo sapiens
aatcactgcattgctgatgggaatcatcctgatggagaaatccaagggcaagggacagcagctgggctctactcctgacgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431667 - DNA, 972 bp, Homo sapiens
  misc_feature (972)..(972): n is a, c, g, or t
gggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagagaattttgtagccaccttggctaatgggatgagcctccagccgcctcttgaagaagtaaccccttttgcccttcctgtagttgccccctttcctctccctccctccccactgttgactgattcgaaaacgcggctccccacgcacggcaagatgcgcccaggccacggaggacaacaacggcaaagcccacgcgagaaactgacacaaagagtagaacagaccctcggcaactgcaccaacagacaagcgaagaaccgggacacaccaacgcaacgcgcaaagacagacacctaaaaacaggcaatatagaacgcacccacacaaacagctgcggacccgccgcgccgcaacatagagaagacaaagactcaccgagggacgcagaaacagcaccacaaacgacggaaccgccacgcgcgacacgccacn

SEQ ID NO: 431668 - DNA, 148 bp, Homo sapiens
gcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagtttt

SEQ ID NO: 431669 - DNA, 116 bp, Homo sapiens
ccgcccccccccaggacgtttgccaccgtctgtggaaacatttgtggttgtcacccctacaaagactcatgcagcccccgggaccacggcactagctgggaaacggatactggaga

SEQ ID NO: 431670 - DNA, 1591 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431671 - DNA, 1777 bp, Homo sapiens
agagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431672 - DNA, 1663 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431673 - DNA, 1416 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggagaattttgtagccaccttggctaatgggatgagcctccagccgcctcttgaagaagtaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431674 - DNA, 1520 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatc

SEQ ID NO: 431675 - DNA, 1909 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaaaaaaaaaaaaaaaaaaaaaaaaaaggggggggggggaaaaaagagatagccccgcaggaggggggcgcaccaagaatcaccgccgcaacacaccgcgagggtgtttggtgagaaacaagggggcgcaccccacaagagaggagaagcggggctattaaacaacagacgagcgagaaggagcgagcgccgggtaacaaaaaacggcgcgcagccgaagcggggaacaaccccccggccaccaagtgcggagacaacattgtgtggagcaagcagggaacccctcaacacaccacgggggggggggggtacgcacaaaaaatgtggggggcccaaccaccaccaccccatcacaaagaggaagatatttagcagaggacaccccattaacggaaggaaagaaaataaatcataacacgactttttttacataagagggtatattaaaaggggttgggtgctcaaacacacactagtaggtgcagactaaaatatttatcgtgtgaggggcgcagctgagagaaaaaaaaaaggatgtgggagtcactgccgagggagacgagtatgtcaagcagcagtgggaagacgacatttttttttcgc

SEQ ID NO: 431676 - DNA, 1418 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaaaaaacaaaccaacacaaaaacacgaacgcaacaacgcaacaacaaaaaacgaaaaaacaaaaaaacgaaaaatagagaacagagccactaagcaagaccagcgtaacgg

SEQ ID NO: 431677 - DNA, 1835 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggagaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431678 - DNA, 1459 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaacacaaccaacacaacaaaacacaaaccccggggcccattgccgggggcgggaacacgcggcttctcgaatgggcctgggcataacggttccggcccccctttttgtccaacgggtacaccccgccggccccaaaaagagagcggataaatcgaaagccggaccgggttagg

SEQ ID NO: 431679 - DNA, 1570 bp, Homo sapiens
  misc_feature (6)..(6): n is a, c, g, or t
ctcgtncaaattcggcagaggagagactggagagatggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431680 - DNA, 1614 bp, Homo sapiens
tgcatcaacgcgtttgggagctctccaatggtcgacctgcaggcggcgcgaattcactagtgattcagccatgttggccgggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431681 - DNA, 1643 bp, Homo sapiens
agagttggcaaacccctgacctatgatggacgtattctctagccaattactagacggtattctcagacgggccgcctccattgccaatgaaatcttccagcggggtcgcggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431682 - DNA, 2076 bp, Homo sapiens
gggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431683 - DNA, 1897 bp, Homo sapiens
gggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431684 - DNA, 1530 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggagaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431685 - DNA, 1561 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431686 - DNA, 1915 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggagaattttgtagccaccttggctaatgggatgagcctccagccgcctcttgaagaagtaaccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgagagacggtctcgctctgtcgcccaggctagagtgcattggtgcaatcatggctcactgcagcctcgacctccccggctcaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431687 - DNA, 1453 bp, Homo sapiens
tgtgccggtaccttccaaagcggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431688 - DNA, 1261 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggtttagggccggccggggatggaaggcctccgccggtttccaacctgttttatggggttcccaaatctccgggaaaaaaccc

SEQ ID NO: 431689 - DNA, 1545 bp, Homo sapiens
  misc_feature (12)..(12): n is a, c, g, or t
ggaaatgcatgntgaagaatgcccaaactgcttgaaggaacaatgaacaatccaaaagattttcattcatttgacttccatacgcacacatttggcattccacgaaggatgaatgcctgaatggatcgaagggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431690 - DNA, 1478 bp, Homo sapiens
  misc_feature (43)..(43): n is a, c, g, or t
cgacacacttttggcaattccaacgaacgggcagacttcgccntgacacggaaccgatgtgcttggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431691 - DNA, 1131 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgaccctgcaaggcataattggactgtacttcctctctttgttgctctcccactcatcctaaccctactcctaagcacataaccattgcccccgagcaatgctcaattaca

SEQ ID NO: 431692 - DNA, 1503 bp, Homo sapiens
ctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431693 - DNA, 2379 bp, Homo sapiens
agagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431694 - DNA, 2255 bp, Homo sapiens
agagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431695 - DNA, 1030 bp, Homo sapiens
gactctagaggtcccccaacgatggtcctcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggttaggggcctgggctggggggatggggagggcacatcgtgactgtgtttttcataacttatgtttttatatggttgcatttacgccaataaatcctcagctggg

SEQ ID NO: 431696 - DNA, 1105 bp, Homo sapiens
aagaaatcacaggaatgtaaaagaagatatcagaactgctatttatactgatatttaaaaatagattattttaaatttctatttttcatatgttctaatatatataaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431697 - DNA, 1501 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaagaggagcagagacacagcaacaaagaagaatccaccagagaggggcccacaaagctaaacgcgcgtacccagaggtatcacgggacacaagaggggcccccataatagggaagccgaaactacacacacaaaggaccacgtgggccgaacggtttccacacggcgctcagagaaccgtggcgaaacgcgcggggaaaaaccagggaaaaccacgggggcacaagggaaaccggaacacacacgggcggatggtggcaccacacagggggcccacagcaaccc

SEQ ID NO: 431698 - DNA, 1043 bp, Homo sapiens
gacccacgcgtcgcggacgcgtgggtcgaccacgcgtcgcgaccacgcgtcggacccacgcgtcgggagggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431699 - DNA, 1365 bp, Homo sapiens
  misc_feature (6)..(6): n is a, c, g, or t
  misc_feature (24)..(24): n is a, c, g, or t
  misc_feature (60)..(60): n is a, c, g, or t
ccttcnaggtacccggtcccgganttcccggggtggacccaaggcgtccggtaacaagancccacttggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctgggaaaaaaaaaaaaaaaaaaaaaaaaaaaaaaaaaaaaaaaaaaaaaaaggggggggggggaaaaaagagatagccccgcaggaggggggcgcaccaagaatcaccgccgcaacacaccgcgagggtgtttggtgagaaacaagggggcgcaccccacaagagaggagaagcggggctattaaacaacagacgagcgagaaggagcgagcgccgggtaacaaaaaacggcgcgcagccgaagcggggaacaaccccccggccaccaagtgcggagacaacattgtgtggagcaagcagggaacccctcaacacaccacgggggggggggggtacgcacaaaaaatgtggggggcccaaccaccaccaccccatcacaaagaggaagatatttagcagaggacaccccattaacggaaggaaagaaaataaatcataacacgactttttttacataagagggtatattaaaaggggttgggtgctcaaacacacactagtaggtgcagactaaaatatttatcgtgtgaggggcgcagctgagagaaaaaaaaaaggatgtgggagtcactgccgagggagacgagtatgtcaagcagcagtgggaagacgacatttttttttcgc

SEQ ID NO: 431700 - DNA, 349 bp, Homo sapiens
  misc_feature (12)..(12): n is a, c, g, or t
  misc_feature (20)..(20): n is a, c, g, or t
  misc_feature (25)..(25): n is a, c, g, or t
cgagctcggtanccggggcngcganaagacgacagaagggtgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 431701 - DNA, 501 bp, Homo sapiens
agagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggctcattcgtccagccttccatcattccctaccccccggaaagacagagggggtatactcaagaacggctatgacca

SEQ ID NO: 431702 - DNA, 244 bp, Homo sapiens
ctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatct

SEQ ID NO: 431703 - DNA, 596 bp, Homo sapiens
ctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtg

SEQ ID NO: 431704 - DNA, 1819 bp, Homo sapiens
atcatggctgcagatgatctgtgctttcttacattatgactgcacatggttacttgtgtaatacccgaggatgttagatagtattcaagcatggagaacaagttatgtaacctagacgatgagtgatgtaagtatcagaagttgttgaatttgacgaggatcaagttcgaaatgcaaggctattgggtagcattctctatacgttctatcttgaattcatcccatcgtgattaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttt

SEQ ID NO: 431705 - DNA, 1765 bp, Homo sapiens
atcatggctgcagatgatctgtgctttcttacattatgactgcacatggttacttgtgtaatacccgaggatgttagatagtattcaagcatggagaacaagttatgtaacctagacgatgagtgatgtaagtatcagaagttgttgaatttgacgaggatcaagttcgaaatgcaaggctattgggtagcattctctatacgttctatcttgaattcatcccatcgtgattaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaattcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttt

SEQ ID NO: 431706 - DNA, 1804 bp, Homo sapiens
gtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggtttt

SEQ ID NO: 431707 - DNA, 2801 bp, Homo sapiens
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaaggtcaggtgagggcggcagcaccagctccccttgtcccgccctgttcatcctcccattaccaccgcccccacacactcacacgcacacttacgcacagatcattgcagcggatgagatggggctatgacagaagcctcaggctcgtttcctcctccctcctccagccccctcccggcttccagcccattctctttgcagctggggttcctaccctaccctactcccagctccttttccccgcggatggagagatggactctgctgcttacccacccactcccctgcagggggtggaggactgattcagctactgtatccccactgctgtgactggaaatgggggtggggagtgactggtcttttcaaccctggggagttgaggaaaatgtctgctttcacttcagctttcatttgaatactgtgatctggtttttattttgaaatgtataaaaagcaaacccagctacaaaggccttttcacccttccactttgtaactaatcccagtctcttctcatcactcctcctcttacagtactctgctattcatgctcatttcatgttcttaatcttctttcctgtttaaaaattttttttttggaaaaaatttgaaatcatggtccttttttctgctgaatatattctatatattatatatatataaattatatatatatatatatacatatatatgtctggctacctcgttttagtttactttttttctgaagccctggaattctacaagagagatattttgagactgaaacatgtttgtgcctagactggaaagatgcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgtttt

SEQ ID NO: 431708 - DNA, 2729 bp, Homo sapiens
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaaggtcaggtgagggcggcagcaccagctccccttgtcccgccctgttcatcctcccattaccaccgcccccacacactcacacgcacacttacgcacagatcattgcagcggatgagatggggctatgacagaagcctcaggctcgtttcctcctccctcctccagccccctcccggcttccagcccattctctttgcagctggggttcctaccctaccctactcccagctccttttccccgcggatggagagatggactctgctgcttacccacccactcccctgcagggggtggaggactgattcagctactgtatccccactgctgtgactggaaatgggggtggggagtgactggtcttttcaaccctggggagttgaggaaaatgtctgctttcacttcagctttcatttgaatactgtgatctggtttttattttgaaatgtataaaaagcaaacccagctacaaaggccttttcacccttccactttgtaactaatcccagtctcttctcatcactcctcctcttacagtactctgctattcatgctcatttcatgttcttaatcttctttcctgtttaaaaattttttttttggaaaaaatttgaaatcatggtccttttttctgctgaatatattctatatattatatatatataaattatatatatatatatatacatatatatgtctggctacctcgttttagtttactttttttctgaagccctggaattctacaagagagatattttgagactgaaacatgtttgtgcctagactggaaagatgcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgtttt

SEQ ID NO: 431709 - DNA, 3114 bp, Homo sapiens
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaaggtcaggtgagggcggcagcaccagctccccttgtcccgccctgttcatcctcccattaccaccgcccccacacactcacacgcacacttacgcacagatcattgcagcggatgagatggggctatgacagaagcctcaggctcgtttcctcctccctcctccagccccctcccggcttccagcccattctctttgcagctggggttcctaccctaccctactcccagctccttttccccgcggatggagagatggactctgctgcttacccacccactcccctgcagggggtggaggactgattcagctactgtatccccactgctgtgactggaaatgggggtggggagtgactggtcttttcaaccctggggagttgaggaaaatgtctgctttcacttcagctttcatttgaatactgtgatctggtttttattttgaaatgtataaaaagcaaacccagctacaaaggccttttcacccttccactttgtaactaatcccagtctcttctcatcactcctcctcttacagtactctgctattcatgctcatttcatgttcttaatcttctttcctgtttaaaaattttttttttggaaaaaatttgaaatcatggtccttttttctgctgaatatattctatatattatatatatataaattatatatatatatatatacatatatatgtctggctacctcgttttagtttactttttttctgaagccctggaattctacaagagagatattttgagactgaaacatgtttgtgcctagactggaaagatgcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgttttgaaaaaaaaaaaaaaaacaacagccttgtatctgcgaattatttttaaggcattgtgtgcttgggtacatgccaaggtaggaggtgttgtttgtatactctaagaggacgcaaggtggagtttggtgcatcctatgtgggggtgagtcaactcatgggtagaattttattctgtataaggtttactactgacatgttttgtttctagaaatgtgattagactggagatttatataatgtttggctttaaactttcaacaacgtggaaatttaaagaaattgaacaaaatgaaactttttaaaaaaccagattt

SEQ ID NO: 431710 - DNA, 1470 bp, Homo sapiens
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaagggattgctctgattttgcctgctggagttgcctttaccaacccagaatatttggtcgtatgtaaagccaagccctccagttgaggtgcaaaagaaagtaagcttgagatcttaactgagcagcaccagagtggggtatgttaaacccccactcccaataaaacaatcgaagtggaat

SEQ ID NO: 431711 - DNA, 273 bp, Homo sapiens
agctcggtacccagttcgacgtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactgtgagtagctgggagggcagggacggggacagagagcaggggcccccaaagggccttggacagagtcggggactgctccatgaatggggaggtagcagggcagg

SEQ ID NO: 431712 - DNA, 7832 bp, Homo sapiens
  misc_feature (2730)..(2730): n is a, c, g, or t
  misc_feature (2754)..(2754): n is a, c, g, or t
  misc_feature (2828)..(2828): n is a, c, g, or t
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggccggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431713 - DNA, 7839 bp, Homo sapiens
  misc_feature (2730)..(2730): n is a, c, g, or t
  misc_feature (2754)..(2754): n is a, c, g, or t
  misc_feature (2828)..(2828): n is a, c, g, or t
  misc_feature (7838)..(7838): n is a, c, g, or t
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggccggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatatcttctggtcggccaaccatgtggtttagccaaggttttgggtgtcccacacctttcccatctcatcttcctttcaaaaattcgtcttattttgtgtcaaccctattttattttcctttacaatgtcacaaaaaagggggcaaccggcgaacctttagacgcttaacgcaaagcggtgtgtgcatctcttcggtttcggccacttccnc

SEQ ID NO: 431714 - DNA, 6132 bp, Homo sapiens
  misc_feature (1030)..(1030): n is a, c, g, or t
  misc_feature (1054)..(1054): n is a, c, g, or t
  misc_feature (1128)..(1128): n is a, c, g, or t
attcagattgagtcctgaggcatttactctcgggtaaaggagagttgagcctgaattaggcatgtgtatattctagggatcctggtgcttatggggaccacgtctgtgggcctgaggtctgggcagccagggctggtgctgtccctgcccacatccgtactggcccgaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431715 - DNA, 5728 bp, Homo sapiens
  misc_feature (626)..(626): n is a, c, g, or t
  misc_feature (650)..(650): n is a, c, g, or t
  misc_feature (724)..(724): n is a, c, g, or t
ctgctccgcccctctctggatcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431716 - DNA, 2317 bp, Homo sapiens
agatgccgctcagtaactgcacccgtgaggtataacacgtagcccactagtcttaccatgtatctgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431717 - DNA, 1952 bp, Homo sapiens
tcctagagtagtcccgattacgctctagacggtgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431718 - DNA, 1553 bp, Homo sapiens
tacgcgcagtagaggtcgggtgttaatcggccgaggggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431719 - DNA, 2305 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggccggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgaggtgactggtagtgctgcctgccagctggggtgcagagcagcctgaggattctgctccttcttttctccaggggcagggctcagctgctccccttcccttgggctctgctctgagggaggggacacacagagggatgtcctggctgagaggtcaggagtgaaggggtttggggctactcccctctgattcctgcctattgtaagagtctgtgcatcagagggaaagaactctctggggccttccctccagaacctggcctccatgctcaactggggaaatgccctcacttcgttaaagtgtactgagcatttgctatgtgccaggctctgccccaggggctgcagaaagagctgtgaacaagacacagtccctgacctcaag

SEQ ID NO: 431720 - DNA, 7880 bp, Homo sapiens
  misc_feature (2778)..(2778): n is a, c, g, or t
  misc_feature (2802)..(2802): n is a, c, g, or t
  misc_feature (2876)..(2876): n is a, c, g, or t
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggccggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431721 - DNA, 6429 bp, Homo sapiens
  misc_feature (1327)..(1327): n is a, c, g, or t
  misc_feature (1351)..(1351): n is a, c, g, or t
  misc_feature (1425)..(1425): n is a, c, g, or t
actgttggagccctgagtagataggtgaacattcggcagtcacagtggtattatggatggcacagtggtgaaagatgtcggaacacgggtggcagattggagagtttggagacagctgacctcaaagaagagcgaggggccaagcatcatagtcaggtgggctgaaggacagggatcgacagacaaccaagaccaggggcaaactcctgccccagctgcagggatgagacatgaccatgatctccattctgatggagctggagcacagaccaaaatccaaccacaatgcagaccttcctctctaatccaaccttgacttaaacctaacactgtccccaggctcagtcaaaacttagccctgtacacaagccaaggttgcctctgtggctgtggcctagcctttagccagcactgagcttagctcccagtataactccagcctcacccctccacctttccttccccatcgaaagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcncagctgttccctgatattcagggncattgctcattgctcccttctcggaccagccttcttcctcccaccatggcaggtggggagcaggtctcccaganacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaaaaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcgcaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431722 - DNA, 2461 bp, Homo sapiens
cgcgaattcaaccgcgggggggtcctcctgttcaaagaagctttcaccatgggcttcattatcttgtcagaagtgaattagtttccaccagggacccctttatcccaaacagcaacacaaaatacaccctaaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctataaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctccagttgaattttctccacccagaccccaaaaataaatggatccatgatgataattaagagaagagaaaaaaagatattatttttgttaggacaaaccattgtaggattttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagtaaaaaaatttgt

SEQ ID NO: 431723 - DNA, 2223 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggccggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgagcggccgcgaattcgcggccgcttgaatacatcttatagtgattaa

SEQ ID NO: 431724 - DNA, 1608 bp, Homo sapiens
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
tnnccgnccnggnaggngcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431725 - DNA, 441 bp, Homo sapiens
cagaggaataaatagaattggagattttttcacaggagcatagctactttattttttattgtagtaaaaagtagacataacataaaatttaccatcttaaccatttttgatggttcagtagtgttaattaagtacattcacattgttgtacaactgatctccagaactctttaggtcttatcaaactgaaactctatacccatgaagcaactccccatttctccttcccctagcccctggcaacccccattctcttttgtgtctctatcaatttgactattatagggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaa

SEQ ID NO: 431726 - DNA, 1631 bp, Homo sapiens
tccgggttggcgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431727 - DNA, 1384 bp, Homo sapiens
tccgggttggcgctgcagtggcgtttccgactgtgggagcctcagcttcccagtcgtccgatgagcccgagcagcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431728 - DNA, 1652 bp, Homo sapiens
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
tnnccgnccnggnaggngcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaaggcctggggctgttggatgtttggggacagctggaaagcctttcgatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431729 - DNA, 1460 bp, Homo sapiens
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
tnnccgnccnggnaggngcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431730 - DNA, 967 bp, Homo sapiens
gtttgaaaaatttatgtaactaatacatggtgcatgatactttctacttaggaatcttgttaggtttagaaactctcctttaaaaaaaaggctgagtttcagattgaaaattgaagggacagcctttgaatgatgtctctttagaaaaatttcctgtctctttagattgtaacgaaaggccaagtgccaggttttatctgatgggtctgagttatattgtacagtttacgtttggcctaatttctgtttaagtgggcagggagtgaaagtggggtcgatctacttaaacttttcctcttagttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431731 - DNA, 1334 bp, Homo sapiens
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
tnnccgnccnggnaggngcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaaggcctggggctgttggatgtttggggacagctggaaagcctttcgatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaattcccttgtctctcctattatcagaacttcaagccttatgaacactttatacttcacagaaatgccaggtgctatgggggcttgggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaa

SEQ ID NO: 431732 - DNA, 964 bp, Homo sapiens
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
tnnccgnccnggnaggngcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgata

SEQ ID NO: 431733 - DNA, 711 bp, Homo sapiens
tccgggttggcgctgcagtggcgtttccgactgtgggagcctcagcttcccagtcgtccgatgagcccgagcagcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagtt

SEQ ID NO: 431734 - DNA, 1724 bp, Homo sapiens
tccgggttggcgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggtgcttatgttcaaaagctgttaccggctgtgtgctgtggctcatgcctgtaatcccagcactttgggaggccaacgcgggtggatcacttgagggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431735 - DNA, 1298 bp, Homo sapiens
tccgggttggcgctgcagtggcgtttccgactgtgggagcctcagcttcccagtcgtccgatgagcccgagcagcaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtttccagctttacatgtggtttggctggggctctggcctccaacccggttgatgtggttcgaactcgcatgatgaaccagagggcaatcgtgggacatgtggatctctataagggcactgttgatggtattttaaagatgtggaaacatgagggcttttttgcactctataaaggattttggccaaactggcttcggcttggaccctggaacatcattttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 431736 - DNA, 1313 bp, Homo sapiens
tccgggttggcgctgcagtggcgtttccgactgtgggagcctcagcttcccagtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggacaccagaaaagtaccactgtaagtcatgagatgtctggtctgaattggaaaccctttgtatatggcggccttgcctctatcgtggctgagtttgggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcaggaattgctcctgcgttgctaagacaagcatcatatggcaccattaaaattgggatttaccaaagcttgaagcgcttattcgtagaacgtttagaagatgaaactcttttaattaatatgatctgtggggtagtgtcaggagtgatatcttccactatagccaatcccaccgatgttctaaagattcgaatgcaggctcaaggaagcttgttccaagggagcatgattggaagctttatcgatatataccaacaagaaggcaccaggggtctgtggaggggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaattcccttgtctctcctattatcagaacttcaagccttatgaacactttatacttcacagaaatgccaggtgctatgggggcttgggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaa

SEQ ID NO: 431737 - DNA, 413 bp, Homo sapiens
gagtactgaactgtttcctttattccttgtgtataaaatatattatacacttgaataaattacaaatatataaatatatgtattccaaattacaaatatatataatatataacagtataaattaaatatagcataatatataagattgaattcctagcactggtatcctttaggtagcacttccatgtggaggcatcctggggttttctgacatggggattattcgaactaatgctccaaagagctccattaaactaaactatttaatatatttaaaaccaagcataaactctttggttaagaatttataaatgtttaggcattggggtaaaggaataattcccaaccagaacgtatgtttccttaagctgagactgatggcgggggatagcataaagttcaagtgcctggcc

SEQ ID NO: 431738 - DNA, 630 bp, Homo sapiens
  misc_feature (27)..(27): n is a, c, g, or t
  misc_feature (48)..(48): n is a, c, g, or t
aaaagataggtatgttagataaatgtnataagggtaaagtagatgacncacccttagagtatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgcc

SEQ ID NO: 431739 - DNA, 659 bp, Homo sapiens
tttaaattcacacccaccacctccccggggtttatgacgagaggaaccaaaaattttatcgccagcagcgactgcccatcccaggcagcatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgcc

SEQ ID NO: 431740 - DNA, 464 bp, Homo sapiens
ggcatctcctttatttgtggcatgagagaaatgttcctaatgtgaggctcagctgggtgttacagaacagcctactgggtgtggggagttggtagaataaaaaaattaaacacaagaatgaaacgacacccacaactccaaatgctgaacacgtgtggtttcttccatagaaggaggctggcaagaagcatgaatgtgactgaactcgcagtgcaggtcagtaaaccgaaaaagcaatcgggcaggggagccattctaaaacccgcttcagggcttggacacactttgacccagacattgccatcttggtgtttttgtggcctttttcatgtataggcaatgaggtctgaactttgggatctttgtggctggaaaatgcggtaaggaaagctcagcttgtggaaatttcccattaccagagggaacatgacaatccacggaaaaaaaaatgagtactgaactgt

SEQ ID NO: 431741 - DNA, 1193 bp, Homo sapiens
cacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggaaacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagtgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgcc

SEQ ID NO: 431742 - DNA, 2185 bp, Homo sapiens
tattcttccaaatggaaactgctaatttttgaagcagaaggttgacagcttcagtaagatctcaagagagcgagaagactggaatcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431743 - DNA, 2171 bp, Homo sapiens
cgggcgcaggaagagccgggccgggccgagcggcgcccggagcccgcgggcctgacacgcggcgggacatgcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431744 - DNA, 2206 bp, Homo sapiens
aagcttttctctcgtcctccctactcgggacctggtcgcctcccctccataaaaccattagctcctggtgccagccctatctctgctccatctctcgtggttccagccgggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431745 - DNA, 2134 bp, Homo sapiens
gctcacttccgagctggctctgcatgacaaaggggaaggagcaagtgtcttctttgatctgccccctgccggccccacacacctgcctgttggtgcccccgccccagccgaggcttcgagaaggaaaatcaaaagggggcttggggaagggctgtgtcccagctctcctggaccctgctcgggccactgtcctctcctggcggccccaggacaaaaatacttcccgggctgatgacccgaagcacccgccgccccctcccggagagcctggggacgccgacgcgcgagagtggcgcagtgagccggggcgcgcggggctgcgctcgtcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431746 - DNA, 1770 bp, Homo sapiens
ggctctagttaccgtgtcagcctgtcctgggggcagtcacagccacagtgaccattagcaggcacccaggcctgtctttggctcggaaacggtggcccccaatgtagcctagtttgaacctaggaactgcaggaccagagagattccactggagcctgatggacgggtgacagagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatctcttaagtaaatcaaggaccttttttggttggcgtacttaatgtggtatctcgccagtggagtgaagaagcctctataaacgttgttgaaccatacaagcaatactcttttctgcagacatatgagccc

SEQ ID NO: 431747 - DNA, 2272 bp, Homo sapiens
ggctctagttaccgtgtcagcctgtcctgggggcagtcacagccacagtgaccattagcaggcacccaggcctgtctttggctcggaaacggtggcccccaatgtagcctagtttgaacctaggaactgcaggaccagagagattccactggagcctgatggacgggtgacagagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431748 - DNA, 2156 bp, Homo sapiens
gctggtctgcccttatccgctgagtttccacactgactctccatttctgttttctccagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431749 - DNA, 2427 bp, Homo sapiens
gctcacttccgagctggctctgcatgacaaaggggaaggagcaagtgtcttctttgatctgccccctgccggccccacacacctgcctgttggtgcccccgccccagccgaggcttcgagaaggaaaatcaaaagggggcttggggaagggctgtgtcccagctctcctggaccctgctcgggccactgtcctctcctggcggccccaggacaaaaatacttcccgggctgatgacccgaagcacccgccgccccctcccggagagcctggggacgccgacgcgcgagagtggcgcagtgagccggggcgcgcggggctgcgctcgtcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431750 - DNA, 1328 bp, Homo sapiens
gcggccgcgctgtcgtacttctccttcagccggtccccgaccttgcggaactcggccagctgcagccagcaggtcttgaggctgcaggaccccgagacgccgtggcatttgcaggctacgtctgccatcttatacacagccctgcgacctgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggtgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431751 - DNA, 1530 bp, Homo sapiens
ggctctagttaccgtgtcagcctgtcctgggggcagtcacagccacagtgaccattagcaggcacccaggcctgtctttggctcggaaacggtggcccccaatgtagcctagtttgaacctaggaactgcaggaccagagagattccactggagcctgatggacgggtgacagagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgga

SEQ ID NO: 431752 - DNA, 2785 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgct

SEQ ID NO: 431753 - DNA, 1568 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaaggttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgct

SEQ ID NO: 431754 - DNA, 1467 bp, Homo sapiens
cagcttctggggtgcatttgtgtaattcgatattaatgattcaggattagtcttggaaaagtgcacaggcaaggcttctttcacagctgttctttgagtgggctttgatctcatgtattgtttaaatgtgacttagaagtgatgttttcttctctatggggaaaaaaatagctgcagaattaaaagatgtactggcacttgacactaatcacaaatactaccagcagcccgtcttgaaaaggaattgttattttaacactaagccatgattttgttttcatcctgcccacaggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgct

SEQ ID NO: 431755 - DNA, 2285 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagctacatcacattgttgccacgtatgaacgccctgaaatttggaggctctttccattttcaactgctatcaagacagtcctcctctatcctgtatttgtgatattggttcaaaatagttcacatctcaaagacgaccagttttgctcgcagcagagttgtccaagtatctaattgctctgatactcttcctgctggctctccattatcttttgatttactattaaacaacattatagggttggagttgttggaggccagggacaatgaggcagatgccactttcttcagcactcatgcctgcgattgtccctggacagctttggtgacaagtcaggagactgccttgggattactttggctgtcagctcaatggctcaagtgtaggtgaaaataacaagaaaaaaaaacaaaaacagaatcaatttgggaactctggacaggacaggcattgtgataatgggactgtgaatttagtttcattttaaggttttttttgaaaccttgtgtctaataaggaaatacttttaagaataacagattatatttcttaatttgaccatctcagtcagtgagattgatttcaagtcgacaaggttttgttttaatagaaatcactattagcatata

SEQ ID NO: 431756 - DNA, 1732 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggggaatgaacaacggcttggaaacccgagatgcccacgtcggaggtcaatcattcctcaaactgtagtttcaatggggatagaagatgaacctttgtcctttctaaatttggaaaacatcgt

SEQ ID NO: 431757 - DNA, 254 bp, Homo sapiens
tgtttgtttattttttctgttcatacagattattatttttttgcattaaacagcaaggtttgttgtttttctttctttctttccttctagagaatttgtaagaggaaatgagcttcctcgtccaattcagtatttatgctggtcgcctgttgggagtaaattagtaagtgtttaaatttttgaagtgtttaatcatgtaaataaaagaggagccatttgattttggcctttgttaaatttccctgcctgaaaga

SEQ ID NO: 431758 - DNA, 478 bp, Homo sapiens
aaactggaaacaaattctacatgtaacttcttcagttcagagcagagggtgactgtcacaccagctttttttgttttaacagctacatcacattgttgccacgtatgaacgccctgaaatttggaggctctttccattttcaactgctatcaagacagtcctcctctatcctgtatttgtgatattggttcaaaatagttcacatctcaaagacgaccagttttgctcgcagcagagttgtccaagtatctaattgctctgatactcttcctgctggctctccattatcttttgatttactattaaacaacattatagggttggagttgttggaggccagggacaatgaggcagatgccactttcttcagcactcatgcctgcgattgtccctggacagctttggtgacaagtcaggagactgccttgggattactttggctgtcagctcaatggctcaagtgtaggtgaaaataaca

SEQ ID NO: 431759 - DNA, 3051 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgctattgtgttgtctgtattcattgatttcaggttccaggttttatcacagaaagaggtgtttgtgcaaagcaagtgcatgaataacattagggtggtcatggaggagaagaatctagaagtggttttggatttctgtcatgagaactccaaatactggaaccaacagctcagagtaggcaaaagcattgttcagaaaatgcaagtgaatcacgtttgagatgtttgcactctatgctgtccctccaagaaatgtttattacatttctc

SEQ ID NO: 431760 - DNA, 2731 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgct

SEQ ID NO: 431761 - DNA, 878 bp, Homo sapiens
aaacaaagaaaatgtagcgtttctattaaatctttggattaaatatggttgtgtaatgaagtaaatgtcatgtgtatacacttaacattctaaaaatttgtttcttttactttagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgct

SEQ ID NO: 431762 - DNA, 1703 bp, Homo sapiens
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgcgattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctc

SEQ ID NO: 431763 - DNA, 1333 bp, Homo sapiens
ctctgaggtgccactgcccccgggagcactggccacgctgagttctagctgttctcttggagtggctttgcacagaagcagcccggcgtccagagggccgggtgaatcttcacttcctgccttctctggggtggctctgttgcccccagcctgtaaggctggcctcccctacaatctcagccgacaagagggacatctgacgtgcctctcaatccctgacatcaagacggccttcagcgactgcaccagcaagatcggcaggcgcgattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctc

SEQ ID NO: 431764 - DNA, 1703 bp, Homo sapiens
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgacgtgcctctcaatccctgacatcaagacggccttcagcgactgcaccagcaagatcggcaggcgcgattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctc

SEQ ID NO: 431765 - DNA, 1774 bp, Homo sapiens
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgcgattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctc

SEQ ID NO: 431766 - DNA, 375 bp, Homo sapiens
  misc_feature (44)..(44): n is a, c, g, or t
  misc_feature (67)..(67): n is a, c, g, or t
ccccccaatattggccatatcaccatccaaaaaaaaaaaaaaangcctataggcacggagagaaacntaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431767 - DNA, 363 bp, Homo sapiens
cggcgaatgctagaacgcgcgacaaccgtcgcaaaatcgtataagcttagtggaaaaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431768 - DNA, 735 bp, Homo sapiens
  misc_feature (74)..(74): n is a, c, g, or t
cttagcgtctacgatgtagatatcttcacaattatcactttatacatgataaaattgaaacttgggagccttgnaaggaagcaaatgaagccataagggcaaggccctgatgcaatagaactggcgtccttgtgagaataggaagatgccaggagtgtgatgcacaggtgaaggaccacgtgagaatgcagcagatggcagcttgctcctggcacagtcttttctctactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431769 - DNA, 395 bp, Homo sapiens
  misc_feature (59)..(59): n is a, c, g, or t
  misc_feature (75)..(75): n is a, c, g, or t
  misc_feature (83)..(83): n is a, c, g, or t
  misc_feature (85)..(85): n is a, c, g, or t
cccacccccccagaagaggggaaagacagtaaataaccacacgctgcccaatcaaaaanagctcacataactggncacgaacntngagaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431770 - DNA, 366 bp, Homo sapiens
  misc_feature (8)..(8): n is a, c, g, or t
  misc_feature (31)..(31): n is a, c, g, or t
  misc_feature (54)..(54): n is a, c, g, or t
ggcacganctcgtgcgaattcggcacgaggnggaaggtggagccaccagcctcnccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431771 - DNA, 517 bp, Homo sapiens
  misc_feature (24)..(24): n is a, c, g, or t
  misc_feature (30)..(33): n is a, c, g, or t
tgctgaactgtttgcagggggcanaggaannnnaaaaaatactgttgtccattcactatgtcagatgctaatccagcgtgcgtcctggcagaggttgaagggggctcctcaagtcccaggtccagcttggtgtggttcagctactcgagagacatctgctgctaatggatgagcagtcaacctggacgcaggaaatcattttttatttggaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431772 - DNA, 375 bp, Homo sapiens
tggggaggatggttcgcggacctgaccttcatatctatcctcattctttacatcaccgggcacagaacaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431773 - DNA, 369 bp, Homo sapiens
caccagtacactctacacccgcgcctgcgcagccagcgaaaaccattacccttaacagaaccaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431774 - DNA, 368 bp, Homo sapiens
  misc_feature (42)..(42): n is a, c, g, or t
  misc_feature (51)..(51): n is a, c, g, or t
  misc_feature (61)..(61): n is a, c, g, or t
cccccccccaccccaacgtcaagagggaagcagaaacccacnatacctcangataccgggnaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431775 - DNA, 362 bp, Homo sapiens
ccgcgcgggtgtggaggtagggtgtggtaagatgacgggataggcgcggcctttcaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431776 - DNA, 898 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaaaaaaaaaaaaaaaaaaaaatttttggggggctgggccgaaaaagtttttaaacacaattgtttggggcggggggcccaagggtgacggaacagctggcccatcgcgtgctcccaagggaacgcgcggccggaatagcgcgtgggtctctccaccacaaaaaaaaaagcggcggcgggcggaaccggagcgtgtctggaccaacccaaagagaggtccgggggcaaccggggatcacacacagggaggccaagggagcgaatataaaatagcagaggcaggagataagcagacgagaccagacaacagcacaacagacaccacagcagacggaccgcgacagcagtgcacacacagagcagagactatcaccagggacataaaccgacagagaagaacaacaacaagtcgcc

SEQ ID NO: 431777 - DNA, 696 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacaataatcatatcctctcctcttcgctctctctacccctctccctctacacctctaactccctccccttctacccaacaatttcggcccgcttggcccagcccatttttacctctgccaggtttatcaatgcgctccgaattcgggtccacttggcccaattcccccttaagggggcccgtttactccatggcccgcgttttcgcgtccg

SEQ ID NO: 431778 - DNA, 862 bp, Homo sapiens
tttttttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaccttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcttgctcctggcacagtcttttctctgtatgtgctcatgtctgtgtcctgatttccatttcctagtagggccagtcaaattggattagggcctaaagtaattatctcattttactttacttctttaaaggccatatgtccaaatacagtca

SEQ ID NO: 431779 - DNA, 435 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctggtgagtatgtttctgtcatttttagggttgcttctgcagtttgccttggagtctgggctgtgggaaaggctgctgcgtcctgggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagag

SEQ ID NO: 431780 - DNA, 646 bp, Homo sapiens
  misc_feature (373)..(373): n is a, c, g, or t
cacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcnctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatccccggtcgaccaatcggtgaaatccccgt

SEQ ID NO: 431781 - DNA, 396 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttccacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaacaatgaaaacaaacagaaaaacatgt

SEQ ID NO: 431782 - DNA, 1245 bp, Homo sapiens
tttttttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaccttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcttgctcctggcacagtcttttctctactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431783 - DNA, 796 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgtcctggaggctggaagtgcaaaaggaaggtgtcggcaagatcgtttttttctgagagctctctccttggcttgcagatggcagcttgctcctggcacagtcttttctctactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431784 - DNA, 865 bp, Homo sapiens
gtctctctttcagacttttttttggttttatggtggtaaatacaacccacttggcctttcccctgagactactggttcttttgtcactggagtcccagagatcagggtttgaactagcctaccacttactggtcatgtaactttgggcaattcagtttgcatccctaagcctcaatgtcttcatctgtaggatggaggtaaccataatgcctgtctcagaggctgctgctagtgttaactgtgggacacaacacagagtaaggcacagacgaggtgtgcagaaaacatcagcttcgtggttttttactcttctgcacttgctgtagcattctgcaaagctattattcctttcctagaactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431785 - DNA, 555 bp, Homo sapiens
gtctctccttttccccctccccgccaagaacctcggttttcatctccactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431786 - DNA, 871 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggtccagggttcctttgaccacctcacacctaacaagttccctcactgtctctcactctcccctgaagattctaagctgcctctgtcctgctaaaactgtagacctgagaatgaagtaaggtgcttcagaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431787 - DNA, 523 bp, Homo sapiens
  misc_feature (498)..(498): n is a, c, g, or t
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaagaaaaacaaaantatttggttttatctggctcttaaa

SEQ ID NO: 431788 - DNA, 1374 bp, Homo sapiens
  misc_feature (1349)..(1349): n is a, c, g, or t
tttttttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaccttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcttgctcctggcacagtcttttctctactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggtccagggttcctttgaccacctcacacctaacaagttccctcactgtctctcactctcccctgaagattctaagctgcctctgtcctgctaaaactgtagacctgagaatgaagtaaggtgcttcagaataactgggagatgaaacaggaagctctatgacacacttgatcgaatatgacagacaccgacacctctacctgttgcccgccgatcacagccggaatgcagctgaaagattccctggggcctggttccaaccgcccactctgcatttgcgggtggtctgcctgtgatattttggtcatgggctggtctggtcggtttcccatttgtctggccaggaaaaacaaaantatttggttttatctggctcttaaa

SEQ ID NO: 431789 - DNA, 1598 bp, Homo sapiens
  misc_feature (373)..(373): n is a, c, g, or t
cacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcnctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgcacctgggaggccatgtctcccggggagtctcaggacctcattgggctggaattccacggggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431790 - DNA, 403 bp, Homo sapiens
ctttgactgatcattccaagaacaaaaaattgaccagcccaggcccaccttgccagaatcggggacaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaaaaaccaccatggcctctttggcctaagca

SEQ ID NO: 431791 - DNA, 540 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaggggggggcgcccaaacatactggcctcgttggactcaaaaaaaaagctttgtg

SEQ ID NO: 431792 - DNA, 508 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaaaatcggccctcgctggcctcac

SEQ ID NO: 431793 - DNA, 486 bp, Homo sapiens
ttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacaccgaaaatcacgactcatccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaa

SEQ ID NO: 431794 - DNA, 1897 bp, Homo sapiens
tcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtacttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaagaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagca

SEQ ID NO: 431795 - DNA, 2729 bp, Homo sapiens
agcggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgtttttttttttttttttttttttttttagttttcctttttaatgagctcaccctttaacacaaaaaaagcagggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttactcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattct

SEQ ID NO: 431796 - DNA, 1725 bp, Homo sapiens
agcggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacac

SEQ ID NO: 431797 - DNA, 697 bp, Homo sapiens
tgtggtacagcaaaggccaaacagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgtatcaaccattttaaatctgccctcaaaagcacagaacaaatcagacagcattttgctcacagaggagagggtgtatgagaaccaaattccagcttcagcacatggccttgggtacagctacaagatggaggaagctatttgacctgcatcagactttacgtgaacaaaagggtgttgttatgtccaaagccatcttgccatgcgcagcctgagaatggagccaatgactgagggtggcagagcagaaagatgagataaatggtacgaggctgatatgggagcatccatcactgactaccaggttgctactcccagctcctgtcttcacatctgcataccaaccagtaagaagaggagaaggagcaaggagagcacataactttccttttaaggacacaactagatgccatgttgtgagctgctctgtggagggggacctgtggcgaggaactgagggcagccagcaggcaacagccagctgccatgttgtgagtagccctatggaggggcccaca

SEQ ID NO: 431798 - DNA, 2677 bp, Homo sapiens
agcggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacggctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgtttttttttttttttttttttttttttagttttcctttttaatgagctcaccctttaacacaaaaaaagcagggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttactcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattct

SEQ ID NO: 431799 - DNA, 988 bp, Homo sapiens
gtcattaggttgtgataattctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaaaaaaaaaaaaaaaaaaaaaaaaaaaaaacaaaaacaggggagccgccaaaacagaaacaccccgcaggcgcacacaccatgaccacgatcaaccgcagcctacatgagaaaacgaggtcgcaccacaaagcagaggcgagccacaagcacagaccaagacacgacagtcgcacggagagtaaaaaaagaggagataagaggaagacaagacaacaggaagaggaaaaccgatgggaaagaacacaacaatacagcgagagagagacaaaaaaggggcaaaacaaacaccaaaagagaaatacagcaacagagagaaaataccaaacaccacaacagagaggaaaaccagcaggcggtaaaaacagaaaggagagacataacagcacacgagggaaaaaaaagaaaccaaagcaccaaaacccgggagaatcatcgaataaggaaagaagacaaaataaaagcaccaacagggacacaacgcggcgagaactaaaagacaacacaaacaacaacgacagccacgcacgcgacaacaacaagcacaaagcgcgcaacacaaaaagaagaagacagaagagaggacagacacaaaaaccgcaacaaagaagacaaa

SEQ ID NO: 431800 - DNA, 2301 bp, Homo sapiens
tgtggtacagcaaaggccaaacagctaccaggaggcagcctgaacgtgtcagggcctgggcacgacacttgcctttcttggaggagtgatttgaagccatagtggaagactgagcctctataaaaaatgaacgaggacactcttaatggacagatacaaaacaagccccaggagaaaggtgttgttatgtccaaagccatcttgccatgcgcagcctgagaatggagccaatgactgagggtggcagagcagaaagatggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgtttttttttttttttttttttttttttagttttcctttttaatgagctcaccctttaacacaaaaaaagcagggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttactcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattct

SEQ ID NO: 431801 - DNA, 1342 bp, Homo sapiens
tataagctattttcttcataagtagaaatggaagatttctgttaggaaggtagaagtcagttttgtccgtatgtgggccaaactattaaaaataataaggcctggggattcctatgttcttagatgctcaataaacatttcagttcatcaaactatgaccaacttacaagtctgtggcattgtgctagttcactggaccctgggaaagtcttttaaatccaaatgatactttttgttttttaaagagacaggattttgctctgttgcctaggctggagtgcagtggcatgtgatcacagctcactgtaaccttgagctcctggggctccagtgtcctacctcagcctcttcagtagctaggactaaggcacatcccaccacacccaggcaattttaggaattttttgtagatggctcttactatgttgttcaggctgggtctcttactcctgggcctcaagtgatcctcctggcctcagcctcccagtgttgggactacaagcaccagccactgcccccaaccctgcattatgttcttaaaggcagacctgaatcctgtgcggtgtcaattcaggtgtgcactggcccctgagccttacatacaggacccgttccttaggatgacgttgcgttcccttgcttagagcctcagcaccatggcacctggctctcccccgatgcctgggtcttgctcttgcccatttcctagccagggtttgtggtccaggcaacctgtcacatcagtgtgttccaaacatggcacccagatctcaaaagcttcttcaacgctcccatggtttgggatacacctcaagttttaacttacgtacttcaagtttcttttattcaattagatacaaaccgtctgacttttggcttctgaaacaggaaagtcaattttgttgttttcactgtaccatgcttttttatctcagaatcttgatgaactctgaaatgacccctgatgggggcatgcctctatttatgctgaataagagccattttacattttactacaggttgagtgcccctaatccaaaaatttgaaatgctccaaaatctgaaactttttgagcacttacatggtattgaaaggaaatgctcattggaacatttcctattaggcatgctcagccgttaagcataatgcaaatattaaaaaaaaaaatttcctaaatcttttaatacttctggttccaagcatttcagataagggatactcaagctctacctattcccaaattcccactaactagctctttggcaggtctatggaataaaaatcgatgcttctgattactttaaggcattataacctcatgaagtggtttctgagatgcaa

SEQ ID NO: 431802 - DNA, 590 bp, Homo sapiens
cacgcgtacggggccaattctctagttgacagtgcccctcagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagca

SEQ ID NO: 431803 - DNA, 2609 bp, Homo sapiens
ctaatgcagggttaggcttacgtctgaattccacaagacatcctccccctccagtacggaagttccaaggcacttgttttccagcatatcagcctaacctcagtgccttgaaatatggctttaagctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagaagggcctggtggtgaaagcggccagggaccagaatgctccagacctacagagctggtcaaggttaagtgccttaaacttaccaatcctgggctcagttctcctttgaaaggagaaagtctttgtcctctacttaggcagctgggctagaagtgccttttgacttctaatgttaactaccctccaaagcctcctgggtcaagaaggctctcccaaactccacccctgttcttcctggtcagagaaccagtcagtcattctagtcttctagtccttaaactgatctgatgacttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaattttgcttttcaagtgcatatacactattaatattttttacccaagagagcattctaagctaatttatgcagtgtgactgtattaagcattaagcttccttcagagctggcctatcggagatgctactgccctctctacagatgtgtctgaaatgcctgcccaaggatggcccttagccagttaacagctttatagcccatcctcattgcttactgccacccctcagctggggtccaaggcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattttaaggttttgtggttcctcggccacaatgggtgatgtcactgatagaacgaagctgagtttccaagggtttggggctgtgcaagagtaaacactagagcttgagttgttatccagctggcaagcacggaagtctttgaagaatgtaatgtacaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagca

SEQ ID NO: 431804 - DNA, 1253 bp, Homo sapiens
tgtctggaggcaggtctggtgaataaactgaatagtactgccttggaccccagctgaggggtggcagtaagcaatgaggatgggctattaagcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattttaaggttttgtggttcctcggccacaatgggtgatgtcactgatagaacgaagctgagtttccaagggtttggggctgtgcaagagtaaacactagagcttgagttgttatccagctggcaagcacggaagtctttgaagaatgtaatgtacaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagca

SEQ ID NO: 431805 - DNA, 2961 bp, Homo sapiens
ctaatgcagggttaggcttacgtctgaattccacaagacatcctccccctccagtacggaagttccaaggcacttgttttccagcatatcagcctaacctcagtgccttgaaatatggctttaagctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagaagggcctggtggtgaaagcggccagggaccagaatgctccagacctacagagctggtcaaggttaagtgccttaaacttaccaatcctgggctcagttctcctttgaaaggagaaagtctttgtcctctacttaggcagctgggctagaagtgccttttgacttctaatgttaactaccctccaaagcctcctgggtcaagaaggctctcccaaactccacccctgttcttcctggtcagagaaccagtcagtcattctagtcttctagtccttaaactgatctgatgacttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaattttgcttttcaagtgcatatacactattaatattttttacccaagagagcattctaagctaatttatgcagtgtgactgtattaagcattaagcttccttcagagctggcctatcggagatgctactgccctctctacagatgtgtctgaaatgcctgcccaaggatggcccttagccagttaacagctttatagcccatcctcattgcttactgccacccctcagctggggtccaaggcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattttaaggttttgtggttcctcggccacaatgggtgatgtcactgatagaacgaagctgagtttccaagggtttggggctgtgcaagagtaaacactagagcttgagttgttatccagctggcaagcacggaagtctttgaagaatgtaatgtacaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgaggaatcagatggtcatacagccataggcacccacccgaaatttccctaggagttggagtaatgctagaattgaagaccttctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagcaactgtttttgccaagagttgtgaaataacttgtgtacttggggaagtggaggttaaatacctgccctaaagtcattccaccaccgagtcagcactggaaatctcatctcttgctttgccacactattttaagagctgtccctgttggaacataacaactagacagactcatgtagcattagagttggaaggtctttttaaagacatctggtcctacttcttacatgatacacaattccccctaccaactacctatgaagagcccttctgtcatacggagctccatcctgggataattctattttaggaactattagattgtcatactaagccaaaagctgcctcatgtcccg

SEQ ID NO: 431806 - DNA, 2877 bp, Homo sapiens
ctaatgcagggttaggcttacgtctgaattccacaagacatcctccccctccagtacggaagttccaaggcacttgttttccagcatatcagcctaacctcagtgccttgaaatatggctttaagctttgagaactgagatttcctgaaaccataggcccttgccccaggggtttctccacatccgggtgttaagacacctgatggcactgttggtttgtcccctataccccagaaaatctatcctgcaaggtagctacttcaatcttgtcattaaaatgtgtcaagtcacagctcgcaatgccaaaggaatgctggggcagtaagtgaggtggataagtgagaagggcctggtggtgaaagcggccagggaccagaatgctccagacctacagagctggtcaaggttaagtgccttaaacttaccaatcctgggctcagttctcctttgaaaggagaaagtctttgtcctctacttaggcagctgggctagaagtgccttttgacttctaatgttaactaccctccaaagcctcctgggtcaagaaggctctcccaaactccacccctgttcttcctggtcagagaaccagtcagtcattctagtcttctagtccttaaactgatctgatgacttggaacataggatttcactgcaagtctggctttttagtctggaaatacatttgaggtctgttttcgcacagctggatcacctgtttcctggttttattacacaattcagaaggctagaagaggagtttgggggcttggcacctgaaaatttagaccgcattcttattaagtaaaggaagaggtagggaggccgaggcgggcggatcatgaaatcaggagatccagaccgtcctggctaacacagaaaccccgtctctactaaaaatacaaaaaattagctgggcatggtgacatgtgcctgtagtccatcccagctactcgggaggccgaggcaagagaatcacctaaacctggaaggcggaggttgcagtgagccgagatcacaccactgcacttcaggctgggcagcagagcgagactccatctcaaaaaaaaaaaaaaaaggaagaggtaaaaggcaaggcagcatttaataagtacctgttgtatccttttaagtgtttgttgtggtaatcctcacaaagaccgggactgatggaaactccttgctattaaactttttttcttgaggaattttgcttttcaagtgcatatacactattaatattttttacccaagagagcattctaagctaatttatgcagtgtgactgtattaagcattaagcttccttcagagctggcctatcggagatgctactgccctctctacagatgtgtctgaaatgcctgcccaaggatggcccttagccagttaacagctttatagcccatcctcattgcttactgccacccctcagctggggtccaaggcagtactattcagtttattcaccagacctgcctccagacatctacttctttcaaaaattagtgttttccatcaaggagcatgttccagagcatttcccagagatgtcccaaagaacactgtccggtgctgtggcgtacagtggcaacagcattagactaagtggaacatcccagcaggctgctttagaatccgctcatttgactagatacgatgtaattggctgtctttaaaaaacgcgcacacacacacaatctgataggcatatctcatgcccattcaatatggaatgttcttcgcttgctgaatttaagcctgtattttaaggttttgtggttcctcggccacaatgggtgatgtcactgatagaacgaagctgagtttccaagggtttggggctgtgcaagagtaaacactagagcttgagttgttatccagctggcaagcacggaagtctttgaagaatgtaatgtacaaaagggaaaagaatgtaaagctttttgtaccaaatgagagttggagcccagccaacaaatgcttttccctgtgtaaaagtctctctggaagggacattccatctccatggtgcactctgaggggcactgtcaactagagattggccccatccaggtgggaggaacccctttgggatggtgagtatccaatctgctgtgcatttgacaggatctctgaatggctaggtaatggatcccaagcaggctcacaaatttaaatgagggctttgtgtgcagaaagaggaataagtacagattattttcctaccactagatttttggggagagtcaccatggaatgttgacaattacttaaaatattttaagctcccttgctgaattcctgtcctgtccctgagtaaagggcttctctgccttctcagaggcaggagaatttgcactggttgtgttaaatgtataaaaagctatatgttcaccagtttactcatttccaatgtgtagatgaataaaatgtagtgtacaaattatttgaaaatcccagaaggaaggtacttttcaaatacagtattttttttaacaaataaacttacgatttttacagcaactgtttttgccaagagttgtgaaataacttgtgtacttggggaagtggaggttaaatacctgccctaaagtcattccaccaccgagtcagcactggaaatctcatctcttgctttgccacactattttaagagctgtccctgttggaacataacaactagacagactcatgtagcattagagttggaaggtctttttaaagacatctggtcctacttcttacatgatacacaattccccctaccaactacctatgaagagcccttctgtcatacggagctccatcctgggataattctattttaggaactattagattgtcatactaagccaaaagctgcctcatgtcccg

SEQ ID NO: 431807 - DNA, 454 bp, Homo sapiens
actgaatctggctcaaggggacatgaaatttgactgggtcatgggactcaggagcatcactctcaaaaatagcagtacaggaagaggcgatggccctaaacagcatttgcaggcagatcccatgttaatcataagggccaggactctctcactgtctgtctctctctctgtctctcctctagggctgaccccacattggacaccgctgcatccatgtccatcacacaacacagctgccgtttcttctgcctgcttatgggaaatgggctcaggaggtctggatctggggtggggatctggagtggaaggggaattcatttgttcattgtctatccttttgtattgattgaattttttatatatatatgtgaattttcacaataaaatttttttccaaaataaaataaacaaaaggggctttttgcaacccaattcctatctatgtctgagtcca

SEQ ID NO: 431808 - DNA, 2174 bp, Homo sapiens
gtccgatccctaaccagtcccaggcccagccccagcccagcaccacctggaaggttcaagtacatggaggagaggagtaaggcggacttgggcgtatggagaaaggggtgaagggagaaagaggacttgcgctcaggagggagcgtggcctactggttgggaaagcaggcgtggccgcctgtgcgggaggttgcggatccacagtgggcgagaccaggccccagccccatcagggcgcggggtgcgcagccaggtggtgctccagcagcgcccagtgagaggagaccttgcggtagacgggggaagggcgcgcgctctggccgctgagtgcgcatgtgcatattgagcgaactcttctgcgggaagggcttggcgtagaccgcgcactggaaggcgtgcgcgcaggtgtgcgtgaccatgtgcttgaaacggcagtagcgcagcgagaaggatcgccatcacacggcgcactggtgcggcttctcccccgagtggatgaacatgtgcttggtgtcgtttttccttgagctgaacgtcttgcaacagtggccgcacgcatagggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttctttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatgtaagaatcctgtactcgttccccctaaatataaaaaaaaagttgaaggaggcagaagggagagtgatgcacgatgggcaaggacttcacctgctgttgctggctttgaggatggaggaaggaggccacaaacctagaagctggagcccctagaagctagaaaaggcagggacccgattctttccttgagcctccagaagggacacagccccgccagcaccttgactttagcctggtgagatcctcttaggacttttggcaatcagaactataagacagaaatggaagccactgagtctgtagctgtttgttgcagcagcaatagaaaactaatgcagggcccaagaaatcactggtgatgagatcgggaaagtgggctcaggaggtctggatctgtgatgagatggggaaagtgggctcaggaggtctggatctgtgatgagatcgggaaagtgggctcaagaggtctggatctgtggtgagatgggggaagtgggctcaggaggtctggatctgtgatgagatggggaaagtgggctcaggaggtctggatctgtgatgagatgggggaagtgggctcaggaggtctggatctggggtggggatctggagtggaaggggaattcatttgttcattgtctatccttttgtattgattgaattttttatatatatatgtgaattttcacaataaaatttttttccaaaataaaataaacaaaaggggctttttgcaacccaattcctatctatgtctgagtcca

SEQ ID NO: 431809 - DNA, 2068 bp, Homo sapiens
ccaggaggtccaggctgcagtgagccatgatcaggccactgcactccagcctgggtgacagagtgaaacactgtttctaaaaataaaaattaaagaataatggatggccttattcagccatggggagcaccaccaatacatgtattggtggtgctccagcagcgcccagtgagaggagaccttgcggtagacgggggaagggcgcgcgctctggccgctgagtgcgcatgtgcatattgagcgaactcttctgcgggaagggcttggcgtagaccgcgcactggaaggcgtgcgcgcaggtgtgcgtgaccatgtgcttgaaacggcagtagcgcagcgagaaggatcgccatcacacggcgcactggtgcggcttctcccccgagtggatgaacatgtgcttggtgtcgtttttccttgagctgaacgtcttgcaacagtggccgcacgcatagggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttctttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatgtaagaatcctgtactcgttccccctaaatataaaaaaaaagttgaaggaggcagaagggagagtgatgcacgatgggcaaggacttcacctgctgttgctggctttgaggatggaggaaggaggccacaaacctagaagctggagcccctagaagctagaaaaggcagggacccgattctttccttgagcctccagaagggacacagccccgccagcaccttgactttagcctggtgagatcctcttaggacttttggcaatcagaactataagacagaaatggaagccactgagtctgtagctgtttgttgcagcagcaatagaaaactaatgcagggcccaagaaatcactggtgatgagatcgggaaagtgggctcaggaggtctggatctgtgatgagatggggaaagtgggctcaggaggtctggatctgtgatgagatcgggaaagtgggctcaagaggtctggatctgtggtgagatgggggaagtgggctcaggaggtctggatctgtgatgagatggggaaagtgggctcaggaggtctggatctgtgatgagatgggggaagtgggctcaggaggtctggatctggggtggggatctggagtggaaggggaattcatttgttcattgtctatccttttgtattgattgaattttttatatatatatgtgaattttcacaataaaatttttttccaaaataaaataaacaaaaggggctttttgcaacccaattcctatctatgtctgagtcca

SEQ ID NO: 431810 - DNA, 1552 bp, Homo sapiens
gtccgatccctaaccagtcccaggcccagccccagcccagcaccacctggaaggttcaagtacatggaggagaggagtaaggcggacttgggcgtatggagaaaggggtgaagggagaaagaggacttgcgctcaggagggagcgtggcctactggttgggaaagcaggcgtggccgcctgtgcgggaggttgcggatccacagtgggcgagaccaggccccagccccatcagggcgcggggtgcgcagccaggtggtgctccagcagcgcccagtgagaggagaccttgcggtagacgggggaagggcgcgcgctctggccgctgagtgcgcatgtgcatattgagcgaactcttctgcgggaagggcttggcgtagaccgcgcactggaaggcgtgcgcgcaggtgtgcgtgaccatgtgcttgaaacggcagtagcgcagcgagaaggatcgccatcacacggcgcactggtgcggcttctcccccgagtggatgaacatgtgcttggtgtcgtttttccttgagctgaacgtcttgcaacagtggccgcacgcatagggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttctttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatgtaagaatcctgtactcgttccccctaaatataaaaaaaaagttgaaggaggcagaagggagagtgatgcacgatgcacgtgatccacaatgcacgtggatcacaatgcacgtggatcacatgagatcctctagatcaccct

SEQ ID NO: 431811 - DNA, 262 bp, Homo sapiens
ccactgagtctgtagctgtttgttgcagcagcaatagaaaactaatgcagggcccaagaaatcactggtgatgagatcgggaaagtgggctcaggaggtctggatctgtgatgagatggggaaagtgggctcaagaggtctggatctgtggtgagatgggggaagtgggctcaggaggtctggatctgtgatgagatggggaaagtgggctcaggaggtctggatctgtgatgagatggggaaagtgggctcaggaggtctg

SEQ ID NO: 431812 - DNA, 1516 bp, Homo sapiens
tccgggccgtgctgggacctttgctccacgaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431813 - DNA, 1758 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431814 - DNA, 1796 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431815 - DNA, 1696 bp, Homo sapiens
tccgggccgtgctgggacctttgctccacgaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431816 - DNA, 1709 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttgacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431817 - DNA, 1832 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431818 - DNA, 1875 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttgggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431819 - DNA, 1911 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431820 - DNA, 1553 bp, Homo sapiens
catcttacttagggacctgctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431821 - DNA, 1716 bp, Homo sapiens
tccgggccgtgctgggacctttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431822 - DNA, 1695 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttgggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431823 - DNA, 2047 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431824 - DNA, 1286 bp, Homo sapiens
catcttacttagggacctgctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431825 - DNA, 1283 bp, Homo sapiens
  misc_feature (23)..(23): n is a, c, g, or t
  misc_feature (91)..(91): n is a, c, g, or t
  misc_feature (94)..(94): n is a, c, g, or t
aaatccagtcatcacagagtggngaagtgcttactattgacctcctttattgatgaagaaacaaaacttttttttttttgagacgaagtgnctnctgtcatccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431826 - DNA, 1453 bp, Homo sapiens
catcttacttagggacctgctggggtgcggggaaaaggcgcagtctcggtgggattgcgtgcaggagggtcgtggtctggctgtggcggaggagcataagaaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431827 - DNA, 1178 bp, Homo sapiens
gagaccatagactggaaggtctccatggtgttcttaaggtgtctcaggttctccgggaagctccccttcagtggcgggtacaccttcagggggtcagcattctggagcaggtgcatcacatggtcctctgtcatgttgccatacttggtggcattctgcatgggcccctggggcagggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431828 - DNA, 1386 bp, Homo sapiens
catcttacttagggacctgctggggtgcggggaaaaggcgcagtctcggtgggattgcgtgcaggagggtcgtggtctggctgtggcggaggagcataagaaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431829 - DNA, 917 bp, Homo sapiens
catcttacttagggacctgctggggtgcggggaaaaggcgcagtctcggtgggattgcgtgcaggagggtcgtggtctggctgtggcggaggagcataagaaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431830 - DNA, 1864 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431831 - DNA, 1992 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431832 - DNA, 1252 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctacaatgctctgagctgcgagggctgcaagggattcttccgccgcagcgtcatcaagggagcgcactacatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431833 - DNA, 1449 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctacaatgctctgagctgcgagggctgcaagggattcttccgccgcagcgtcatcaagggagcgcactacatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggtttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtgg

SEQ ID NO: 431834 - DNA, 1041 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccaggttctcacccccaatctggcctggttaccggaaatggcatgatcgagagtcctcgtgccagaacagttacgggctccttttgacgttgggtcgctggctgaaggtccatcgggagcctacagttgccttctatcgctttgtcgagcttttgaaacggactgtcacgatgaagtcatactccgtggctcgacgga

SEQ ID NO: 431835 - DNA, 846 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcgagatcctcccgtggcattaaaagagagtcaaagggt

SEQ ID NO: 431836 - DNA, 807 bp, Homo sapiens
catcttacttagggacctgctggggtgcggggaaaaggcgcagtctcggtgggattgcgtgcaggagggtcgtggtctggctgtggcggaggagcataagaaggactccagattcaattatttatatatacttcaggatttaaactttgcttccagagttgtcatggaggaggccaagaagcaaatagagacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcgagatcctcccgtggcattaaaagagagtcaaagggt

SEQ ID NO: 431837 - DNA, 193 bp, Homo sapiens
gtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttcccca

SEQ ID NO: 431838 - DNA, 604 bp, Homo sapiens
ggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctggtaagcttcattccatccctct

SEQ ID NO: 431839 - DNA, 1955 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggtttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtgg

SEQ ID NO: 431840 - DNA, 1340 bp, Homo sapiens
catcttacttagggacctgctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431841 - DNA, 457 bp, Homo sapiens
  misc_feature (16)..(16): n is a, c, g, or t
  misc_feature (97)..(97): n is a, c, g, or t
  misc_feature (100)..(100): n is a, c, g, or t
  misc_feature (120)..(120): n is a, c, g, or t
  misc_feature (133)..(133): n is a, c, g, or t
  misc_feature (150)..(150): n is a, c, g, or t
  misc_feature (158)..(158): n is a, c, g, or t
taccgacgcgactcgnttgccgtgcgagacgcgggcgcgcgaacggctgcaaggaccaagcgtcgcgaggtcagagaggcgtgcgagcgacgacgantantgtggaagcgcgcgtgcgantcgcgcgtacggntggccgaccgacgcgancgcgcgcnagtgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431842 - DNA, 983 bp, Homo sapiens
ctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttgggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggccgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 431843 - DNA, 480 bp, Homo sapiens
tgtgatcttgagtagattagtatcattaggattctgagtatagtacctggttttcttttgctgtgtatctttttgtttttttctaggcttggtttttctatggaatttccactaaatcaactaaactttttgccatttatctaaatcattcacagcaatcagctttattagggtactctgtttcattttcctgagtaagcgtttcctggagtcttctgacccgcccctgactggactgatagccttctatgcctgatgtgtgtggctatattctgggaactcccttctctatgcctgatatgtgactgtattctgggaactcccttcactattgtccgggaattccttttcttctctcttattatatctcgttttctgttacctagtgtcttggtttactcccttgtttgatggagcctgttttctctggcagtgtcctcctgagaaaggtggcataggaggtgaatgaccttgctggtc

SEQ ID NO: 431844 - DNA, 681 bp, Homo sapiens
agcggagaaaaaacccgcgggcctggccgggtgcaggccacccttgccggcggataggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtaagtgggctgggggctgggccttctgcggctggaccggccttcacctgcaggcagggttggggcaggtgaggagcagatggacccacccagagctcttccaccttctcaggcttgcacccccttcctggagccttatccacaccctcagtcctcgctctcactgtgggggagctgcagaggatgcggtttttccacattccatctccacccacaggaggctttgagatggggggagctctcctgggcctgaatgtgtgccgtcctg

SEQ ID NO: 431845 - DNA, 4175 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgtgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431846 - DNA, 2199 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 431847 - DNA, 4527 bp, Homo sapiens
agcggagaaaaaacccgcgggcctggccgggtgcaggccacccttgccggcggataggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431848 - DNA, 4203 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccaattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431849 - DNA, 4023 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431850 - DNA, 4222 bp, Homo sapiens
agcggagaaaaaacccgcgggcctggccgggtgcaggccacccttgccggcggataggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacactgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431851 - DNA, 3652 bp, Homo sapiens
gactgtgatcccaccactggggagactgatgacgaaggctatgaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431852 - DNA, 3532 bp, Homo sapiens
  misc_feature (73)..(73): n is a, c, g, or t
  misc_feature (123)..(123): n is a, c, g, or t
aatgtttcttgatgactgttcttgtatggtcgacgtcggtggtcaacagtatgtatagtgatgccattggctnattatacaaggtgttacccctcagtggagcatcgctctggactcagaacntgacctcagtattgcaagtagagactttcgtcctcgcaagtaatagacatgcgtccacgtgtcgtataaccgagcagtactgttaacacattcctaacactcactttctgagtatctatcattggtatttcatgaactggagttgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431853 - DNA, 3322 bp, Homo sapiens
  misc_feature (62)..(62): n is a, c, g, or t
ttgtgcgatctcggttacgtgcgttttctcggaattttatttccgctcccttatttgggggnccccgcgcgatttccccaccgtggggaccaaaaaaacttgggtccaaggagaaccaccttatgacccaatggcgcaattccaaacgcccgttttgtccgcgcgcgccccgcgcgattagatagcgcctcgggatttttttttttttttaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431854 - DNA, 4229 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431855 - DNA, 4159 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431856 - DNA, 4122 bp, Homo sapiens
ccagactgttccagaaacagcctggggattctgaatgtttcccagagaatcattaggaattatcccagcggcgctggagtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431857 - DNA, 3948 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431858 - DNA, 3962 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagcgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431859 - DNA, 1264 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 431860 - DNA, 3294 bp, Homo sapiens
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacgacttttcatgttttggagtggacttttaaaaaagttttccaaccacaatggaaacaggttgaaccacactgcgcctacacatccatccatacgtcagccattataatcagattctcactgggggaggcattttcttcccaaaggagctgtatgcagtcatcacccggaactaatgggaaagtgttcttaagcagcaagtgactctggaccacctctctcacacactgactcttccacagcatcttcacctgcttctgtttcacttgaattcatacagtaggccaccattttataacaggtcttagtgtaaattcttccagaccaagtctgagatagtcttggttgtaaagcaagaccgtcaccccttctcccaaagccaacattataaaaagattccattgtctcaaacacaaatgttccagtcttgagcacttcccagccatggtgactcgggcatatcctggcagttggtggattttgccctgtaacacaatccttgtggatatgattcaaaggtgactttaattcagagaatgtgttttcctttctgttttaaaaatatttgaattaagtgatggaaattcttttgttaaacatcaaaagctttctccttgaaaagatgcttggtgtatctgaaagtcacgtgggacatttggtgcattcagaaggtcaaatcattcctgacctctcctcttaggacccagcattaactgctgcgatactcaaggcttccttaaaggatcacagcactggcgcctagttttactgtccagcaactttattagttgtgctagctgagaattggaatatagagtcctttgaatgttacgatcttgttttcaaaacctggagtcaaaccaattaagtatggacttaacaaagacaattgatgatgtgaaatgataccacctgtcaagggcatagttaccatgtggatagaaagatgagtccactgattatcttcaaatcccatgtattctctctagcacgttgcttctgacagaaagaataactcacagatttgaagtttgttcctttcccctgatgaagagtagattggccaaaaggtagatgacaggaaggaagaggagccagaatgacccacagtgatcagttcagcagtgcagagcggcagtgcagaggctcatggaactcacacggaaaaaggaaacacatgctgcttaaaatgcacgataacttaattatccaaattaccattcaattccggtatttttgagatgaaagcatttgagccaacactaaattgaccgtaattaaggaatgaggtaggaagaggcacttttaatctggaggaagaaataaatggaagactgtaataggaaaaatacaggtctaggaaaaaaataatttttttcctttgatgctggccaaggacccctctacataatacagttctcctgctggaaagcatcagggcaaacagagttattccaaactctgcaacagggaagactgtactttgaccttcttttcctggggaaagggaacaactagtaatctttaaatgtcaaaacttttcttctaaatagtacattcattaaccagtttcttctggtggtgcaaagaacactcaccacagtgagcaataccactattcaatttcccctttggagaggtgacagcggggtagaatcacctggagtcagctgctagtctttaactgatgacaaggccttgcaaatacccctgagaacaatttcactctgagctcacagggaagcagcagtctggtgtgggctcctgtggtgtaaccatcaaatgtggaagacctgatggtgttagtgtgtggggatgccgggctgaaattcaacagccttgcaaaaagaaagggaagatgggatgtgttaatattgtagtggcatgcactttccagctctccatggagctctctttatatatgaggtaattgaatgtcactattctgtaccatacagcaggtattatctagccaaggttataattaccatgaagtgctgtggaatgtagtaggaggcttttcactggga

SEQ ID NO: 431861 - DNA, 2632 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431862 - DNA, 2579 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggattaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431863 - DNA, 2578 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagtcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431864 - DNA, 2732 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaaggcttggcctgtacagcacccgccagtcagagctgtgtggcctcaccctctggcagctgagcccagcactgtccttcttggtgccatcttcccctgccgcaccggctgtctccgcccagcccccacctttgggttgtatggttgggctccctagctacacaga

SEQ ID NO: 431865 - DNA, 2405 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccattttaataattccttttggtgtgctgctgaaaattttctattcagaa

SEQ ID NO: 431866 - DNA, 1376 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaagggtgtccaaatggatcagccctgctgccgagctctgtacgactttgaacctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagcggtaattccaaattatttttcagtaagacagttaatcagcattattgtgagagggactgaaaagaaattctccattatgaggaattgggaagaaatctggtatccaagcttaaatttcttgctatacagaaactatgtatgtatttaggctatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431867 - DNA, 768 bp, Homo sapiens
tcagaaatagccataagtgtgttgagctgagatgcctatttgcagagaatgctttgaacccacaattaacacttttctatggatgcattaagagacaaattcattcagatcaggagacaatttgctggtgagggaaggcttactttgacaattccatgactcacatatttctgaagggcacagggaagggggaacaaatatcttcacttcagttttatttgtgaattacatgtttcatgaatccatttggcacagagacacaaggaagaaaacactagtaaccatctttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctgcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431868 - DNA, 1877 bp, Homo sapiens
agcgggtcgagtgtttctcagcaagagcccgtgtcccgctaggctccgcgccctcgcgcccatagccccggcggcggcacgaccagaggcggccaggggagcgcgccgccccgctcggccctccagtcccgctccgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttcttagaatatgaccatgagccatttcacagaaaaaccatcccaccgaagatattgtctatcaccccaggggccatctgaaggtctctttgcatttctccatgcaaagaggagaaacttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaact

SEQ ID NO: 431869 - DNA, 1439 bp, Homo sapiens
tttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacggatttttaaatttagctttatttatcaacccaaaaaacaaataaataagatcaatattctttacttgtcaaa

SEQ ID NO: 431870 - DNA, 1383 bp, Homo sapiens
tttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacggatttttaaatttagctttatttatcaacccaaaaaacaaataaataagatcaatattctttacttgtcaaa

SEQ ID NO: 431871 - DNA, 1475 bp, Homo sapiens
tttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcacatagttatataacattgatactgttagatatgtggatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacggatttttaaatttagctttatttatcaacccaaaaaacaaataaataagatcaatattctttacttgtcaaa

SEQ ID NO: 431872 - DNA, 1038 bp, Homo sapiens
agagtcatcagagggatcagcagctccagggaaggcctggctgccccgcttctaaatgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgt

SEQ ID NO: 431873 - DNA, 1043 bp, Homo sapiens
agagtcatcagagggatcagcagctccagggaaggcctggctgccccgcttctaaatgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggtaacctgccagggcctgggcaagatgcagggggaggtgtggcctgggccccaggactctgctgagtctgcagggccctcgtccctgagccatgtctgtgggtgacacccatgtggcctgtgcagacatgtcagactccatggcccacccagccctccatttcccttggttactggatatgtcctctgggcccagctgcatggcaactgtgctcccaccgcaccttagctctgaatgccacccctgtctctaccaaacaaagccagctcatcctcccaggcccagcaaagaggccacctcttcccctcagccctcctgctctcttcctctgctgaactccagatttctctgggcttctcatttggcatgtcttagtctgcattgtctcatgacttttccttcctttactaattcgttcattcattcattcattcattcaacaaactgtgccaagcaccagagcaatgctgggcagcagagctataggaagaggtggggagagtctgctgtggaggtcacaggtgatgagtgggagtcacagaacacggactctgatattagacagcctg

SEQ ID NO: 431874 - DNA, 684 bp, Homo sapiens
ggatgaaggccatggggtgggggcgtggtcataagggttgggtcccagatgacaagggcagctgaatggagagggatgcagtgcagccgcacctgccctctcggccacctggctctgcagggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgt

SEQ ID NO: 431875 - DNA, 929 bp, Homo sapiens
agagtcatcagagggatcagcagctccagggaaggcctggctgccccgcttctaaatgccactccccctcccatcagcgttcgtgctgtcagccttgcagccttctcctactcattccagctccaatacccagcggctgccagaccgagtgaccggcggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacgggtaacctgccagggcctgggcaagatgcagggggaggtgtggcctgggccccaggactctgctgagtctgcagggccctcgtccctgagccatgtctgtgggtgacacccatgtggcctgtgcagacatgtcagactccatggcccacccagccctccatttcccttggttactggatatgtcctctgggcccagctgcatggcaactgtgctcccaccgcaccttagctctgaatgccacccctgtctctaccaaacaaagccagctcatcctcccaggcccagcaaagaggccacctcttcccctcagccctcctgctctcttcctctgctgaactccagatttctctgggcttctcatttggcatgtcttagtctgcattgtctcatgacttttccttcctttactaattcgttcattcattcattcattcattcaacaaactgtgccaagcaccagagcaatgctgggcagcagagctataggaagaggtggggagagtctgctgtggaggtcacaggtgatgagtgggagtcacagaacacggactctgatattagacagcctg

SEQ ID NO: 431876 - DNA, 629 bp, Homo sapiens
  misc_feature (10)..(11): n is a, c, g, or t
  misc_feature (13)..(13): n is a, c, g, or t
tgcgtatctnngnggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcggctctgacccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgt

SEQ ID NO: 431877 - DNA, 1166 bp, Homo sapiens
  misc_feature (10)..(11): n is a, c, g, or t
  misc_feature (13)..(13): n is a, c, g, or t
tgcgtatctnngnggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgt

SEQ ID NO: 431878 - DNA, 1294 bp, Homo sapiens
  misc_feature (10)..(11): n is a, c, g, or t
  misc_feature (13)..(13): n is a, c, g, or t
  misc_feature (1176)..(1176): n is a, c, g, or t
  misc_feature (1178)..(1178): n is a, c, g, or t
  misc_feature (1274)..(1274): n is a, c, g, or t
tgcgtatctnngnggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgttctcataaantngcttaagtcgtgtgtagcttgaaaaaaaaactcgagggggggcccgggacccaattgggcctatagtgagtaggtttacaattcactggcccgccntttacaacgtccggactggg

SEQ ID NO: 431879 - DNA, 1111 bp, Homo sapiens
  misc_feature (993)..(993): n is a, c, g, or t
  misc_feature (995)..(995): n is a, c, g, or t
  misc_feature (1091)..(1091): n is a, c, g, or t
agagtcatcagagggatcagcagctccagggaaggcctggctgccccgcttctaaatgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggtgaggaaccgccggctcacggtcaccagtggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgttctcataaantngcttaagtcgtgtgtagcttgaaaaaaaaactcgagggggggcccgggacccaattgggcctatagtgagtaggtttacaattcactggcccgccntttacaacgtccggactggg

SEQ ID NO: 431880 - DNA, 1137 bp, Homo sapiens
  misc_feature (10)..(11): n is a, c, g, or t
  misc_feature (13)..(13): n is a, c, g, or t
tgcgtatctnngnggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgacccccacaaagccagatgccacgatggtggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgt

SEQ ID NO: 431881 - DNA, 427 bp, Homo sapiens
gcatctcttggcagtttacctgagtcaggttatgaggacctgtcagcagctaagtgtctctgacaagcagttgactgacatattattgatggagaagaaacaagaagcataaaaggtacagattgagcatcattctttcaaaatagaatcctgtcaagaaatgcattgaaagcgtcatgattcacatggaaaagaggtgaaatggatcttcagacacttcatgttactgtcccttttccctccaggactgcaggaggtgctgtgggttggagccgtgggctgtggagggtttgtgtatgatgagaagccctgtacagtcttctcaagaaataccctgagccagtctctgagacgcttcggtaaaaaatgtccctggatggaatcaagattttaaattcaaataaagcctaatatcatgttgtgtcca

SEQ ID NO: 431882 - DNA, 921 bp, Homo sapiens
ttgcagtgaggccgttatcggacagggggccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcagcctgtcaccgcacctctccttttgtctggtcgacccagagcgctcgcgcactgggtactggtgcatgatgagtcctcttgtgtcagaccgagactcgtcctagacagacttcccaccgatcaacattggtacgacagacgagaatatggatgacc

SEQ ID NO: 431883 - DNA, 1348 bp, Homo sapiens
gcccaactccgctaccagctcttttttttttcttttttgtggtgacggagtctcgttctgtcgcccaggctggagtgcagcagtatgatttcggttcattgcaacctccatctcccaggtttaagcgattctcatgcttcagcctcccgagtagctggcattacaggcgtgcactaccacgcccggctaatttttgtatttttaacagagacggggtttccatgtaggccaggctggtctcgaactcgtgacctcaagtgatccacctgcctcggcctgccaaagtgctgagattacaggcgtgagccactgcacccagcctctgccaccagctgtatggcctcctcttggttcctttctctgtaacctggggagtgcagtagcacctgcccagtggggctcttgagcccaggaactgctacactctgaaccccactcgtactaggggctcagtaacaagcagccgccagtgtggttcctatatcccgggacttcgcctgtctcctgcggatcacagccagtgactactgtgctcttggagaaaggtccagcctccagcttcccaggcttcatttgcatccatctcgcaggccccagctcaggctcgtgcccacccaccaagttccagtgccgcaccagtggcttatgcgtgcccctcacctggcgctgcgacagggacttggactgcagcgatggcagcgatgaggaggagtgcagtgagtggccacgccccttggcggggcttacagggggcggggcctgagggtggtttgtcaggggccaggcacgcggaggtggagcttgtgggaaaggcagggccgcagggatgggtgcgacttgggtctgtgggtcataagaagcggggtctaagatgggcttgggctgggtgcagtggctcacgcctgcaatcccagcactttgggaggctagggtgggaggatcgatcacttgatcctgggaggttgccgctgcagtgagctaggattgtgccagtgcactccagcctgggcaacagagtaagactgtctcaggaaaaaaaaagaaaaagaaaaaaaaaagaaaaatgaaagaaaggaaagaaaggaaggaaagagagagggagggagccaggtacggtggctcacacatgtaatcccagcactttgggaggccaaggcaggcggatcacttgaggtcaggcgttcgagaccagcctggccaacacagtgaaaccccatctctactaaaaatacaaaagttagctggatgtggcggcaggcccctgtaatcccagctagtcaggaggctaaggcaggagaatcacttgaccctgggaggcagaggtttcagtgagtcgagattgcgccac

SEQ ID NO: 431884 - DNA, 1696 bp, Homo sapiens
  misc_feature (1696)..(1696): n is a, c, g, or t
cggctggtcggccggaatttcgggattagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctcaaaaaaaaaaaaaaaaaaaaacaaaaaaaaaaaaaaaaaaaaaaaaaaggggggggggcaaaaatttactcccccgggggggcccaatttcgccccttttttggggaaaagggggccccataggggggagtcgctcattaaaaagaccggggagggggcggccgtaaaaaaccagcgcgcgcgcgacacaggcccaacgggcatcttggggaaagcagccccctctgcgtgcgtgcaactctgtggaccacaccaggagtaaaggcgggacaatccattcgggttcgggtgaccccaggctgtgggcgaattgctcggtttttgaatagcccgccaccaaatcaggagataacaagaacggacggagagagcaacagcagacacagcatgaaaacaacatagtagcgacgacagcaacaccaccgacgcgccaccan

SEQ ID NO: 431885 - DNA, 1207 bp, Homo sapiens
cggctggtcggccggaatttcgggattagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaaagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 431886 - DNA, 899 bp, Homo sapiens
cggctggtcggccggaatttcgggattagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 431887 - DNA, 1259 bp, Homo sapiens
cggctggtcggccggaatttcgggattagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 431888 - DNA, 1036 bp, Homo sapiens
ggagcatttttttgggctcagctgttcttagagggtggggcttgcaggggatggggtttcagggagtacctgggccttcttgggtgggcatttgggacctgaccaaccctgtgccccagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcgattaaagttgcttcacatcctc

SEQ ID NO: 431889 - DNA, 3084 bp, Homo sapiens
agttggcgggaatggctgctcgcggaggggcagtgtacgcggggccgctgtaggctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgaccgtatctggatttagtctgtagcacaaaaattttccttttagtctagcctcgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatctatttattttgtttattgcactttatgaaaactgaagcatcaataaaattagaggacactattgagagtgagccactagcttgattttctttctcctctgatttcagttcactgttcagtttagcattaaaataataaaataatcatacagttcc

SEQ ID NO: 431890 - DNA, 2989 bp, Homo sapiens
agttggcgggaatggctgctcgcggaggggcagtgtacgcggggccgctgtaggctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatggtcctgcggtagactggtgggcacttggagtttgcttgtttgaatttctaacaggaattccccctttcaatgatgaaacaccacaacaagtattccagaatattctgaaaagagatatcccttggccagaaggtgaagaaaagttatctgataatgctcaaagtgcagtagaaatacttttaaccattgatgatacaaagagagctggaatgaaagagctaaaacgtcatcctctcttcagtgatgtggactgggaaaatctgcagcatcagactatgcctttcatcccccagccagatgatgaaacagatacctcctattttgaagccaggaatactgctcagcacctgaccgtatctggatttagtctgtagcacaaaaattttccttttagtctagcctcgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatctatttattttgtttattgcactttatgaaaactgaagcatcaataaaattagaggacact

SEQ ID NO: 431891 - DNA, 2773 bp, Homo sapiens
agttggcgggaatggctgctcgcggaggggcagtgtacgcggggccgctgtaggctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaatgaacatgacttctttagatgcaatggatatttcgtgtgcctacagtggttcatatcccatggctataacccctactcaaaaaagaagatcctgtatgccacatcagaccccaaatcagatcaagtcgggaactccataccgaactccgaagagtgtgagaagaggggtggcccccgttgatgatgggcgaattctaggaaccccagactaccttgcacctgagctgttactaggcagggcccatgagctaaaacgtcatcctctcttcagtgatgtggactgggaaaatctgcagcatcagactatgcctttcatcccccagccagatgatgaaacagatacctcctattttgaagccaggaatactgctcagcacctgaccgtatctggatttagtctgtagcacaaaaattttccttttagtctagcctcgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatctatttattttgtttattgcactttatgaaaactgaagcatcaataaaattagaggacact

SEQ ID NO: 431892 - DNA, 2405 bp, Homo sapiens
agttggcgggaatggctgctcgcggaggggcagtgtacgcggggccgctgtaggctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttttgaagaatcaaatattgaagatccacttattgtaacaccagattgccaagaaaagacctcaccaaaaggtgtcgagaaccctgctgtacaagagagtaaccaaaaaatgttaggtcctcctttggaggtgctgaaaacgttagcctctaaaagaaatgctgttgcttttcgaagttttaacagtcatattaatgcatccaataactcagaaccatccagaattggcttccttttcgtagacttaagtgtgagaaattatagcagcatgaggttagggttgttgaaggtgccgtgccagatcagaatcatggaccacagaaggatgcaaaagaaattgtctaaatctgccctgaatatgggacaagtttgcatgaatatttctaatgagctcttggctgggaaggaattttcgtcctataaattccgataataatgggttcacatagtctttcataagaatgtattagatagcgttacattggtattgaaaacccttgagatttaagaatttaagtataagggggttgagtgttggagatgaccct

SEQ ID NO: 431893 - DNA, 1551 bp, Homo sapiens
agttggcgggaatggctgctcgcggaggggcagtgtacgcggggccgctgtaggctgtccagcgatggatcccaccgcgggaagcaagaaggagcctggaggaggcgcggcgactgaggagggcgtgaataggatcgcagtgccaaaaccgccctccattgaggaattcagcatagtgaagcccattagccggggcgccttcgggaaagtgtatctggggcagaaaggcggcaaattgtatgcagtaaaggttgttaaaaaagcagacatgatcaacaaaaatatgactcatcaggtccaagctgagagagatgcactggcactaagcaaaagcccattcattgtccatttgtattattcactgcagtctgcaaacaatgtctacttggtaatggaatatcttattgggggagatgtcaagtctctcctacatatatatggttattttgatgaagagatggctgtgaaatatatttctgaagtagcactggctctagactaccttcacagacatggaatcatccacagggacttgaaaccggacaatatgcttatttctaatgagggtcatattaaactgacggattttggcctttcaaaagttactttgaatagagatattaatatgatggatatccttacaacaccatcaatggcaaaacctagacaagattattcaagaaccccaggacaagtgttatcgcttatcagctcgttgggatttaacacaccaattgcagaaaaaaatcaagaccctgcaaacatcctttcagcctgtctgtctgaaacatcacagctttctcaaggactcgtatgccctatgtctgtagatcaaaaggacactacgccttattctagcaaattactaaaatcatgtcttgaaacagttgcctccaacccaggaatgcctgtgaagtgtctaacttctaatttactccagtctaggaaaaggctggccacatccagtgccagtagtcaatcccacaccttcatatccagtgtggaatcagaatgccacagcagtcccaaatgggaaaaagattgccaggtttgagggacatttatcttaatgaaaatcaattatgtatgtcaaatgaatgtgagaaatattataccttttcatataaattccataaagaaatgaaattgttacatgaatggcagtcatagtattaatcagaaattcattttcctgcacattctgtcaaattcttttgaaatatttcatttctcattcaattgtgacattgttcttacttgattatataatgagattcttgcagtaaattgataataaatgcttggcttctgtgtatctaggtggacctcacttgtttttagaagtccttcccatgatacagacattggcttgttggttttgttttattttgtttttaacctatgtcatttaaaaactcatattacctccttctatactgtttcctgtcagtttcttgtttaatggaatggtaactcttctggatcagaaataacttttagaccggaaaggtaacgtgggtgtgcccttaaagtgtctgttctgaggatatt

SEQ ID NO: 431894 - DNA, 721 bp, Homo sapiens
agaaagataggcttctaagttaaggcaaatcattcattctgtcattaaacaaatacaaaccaggcacctgtcatatgccaagtgatattcaaaatggcccatgtagacctttgtgaagtatgtggcctaacagacattaaacaaatgtctgtgaaactgacataataaagtaaggtaagttatatgtgagacattctctttttataataattcctgtaaagcagtacttacttaggtaatgatatcatactgttttgttttatatttttcctaagagctaaaacgtcatcctctcttcagtgatgtggactgggaaaatctgcagcatcagactatgcctttcatcccccagccagatgatgaaacagatacctcctattttgaagccaggaatactgctcagcacctgaccgtatctggatttagtctgtagcacaaaaattttccttttagtctagcctcgtgttatagaatgaacttgcataattatatactccttaatactagattgatctaagggggaaagatcattatttaacctagttcaatgtgcttttaatgtacgttacagctttcacagagttaaaaggctgaaaggaatatagtcagtaatttatcttaacctcaaaactgtatataaatcttcaaagcttttttcatctatttattttgtttattgcactttatgaaaactgaagcatcaataaaattagaggacact

SEQ ID NO: 431895 - DNA, 604 bp, Homo sapiens
gacactgccccccatcagggacaaaggtcacccctgggctggcccccatcctctattggggaccttgctcctccatgccctggggaggaagaagagaaataagggtgggtcattgactgggtgctcttggtactcctgcaagaatgtgtgatgagggagaagcagggacccatccaccccagcacaaacatgcttgcacttctctttcctcactaagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcaca

SEQ ID NO: 431896 - DNA, 817 bp, Homo sapiens
ggaggatgtagactctgtccttgttcaggtccccaccttgctgaaggcgccagagctcgtgtagggccaatgagccggctcaggctgagcactgctgagtgggtagatgttactctccagcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcaca

SEQ ID NO: 431897 - DNA, 1458 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431898 - DNA, 2333 bp, Homo sapiens
gtggagactgggtgtctctgcatggcatgtcataggagttcaataaccatagttattattagagggaagggggttttgctgggtgtggcaccttatttctagaaggtgctgcaaaccactgaccagatacagatcacaaatagatgctcttggcctccatgatatcttggaaaaaagtattgattgctgacatttgtcaatgaggcaatttcccagaaaaaaaaaatccctgtttcctttttcctggagaaacatcagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatcgcttgaacctgggaggcggaggttgcgctaagccaagatcgcgccattgcactccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431899 - DNA, 1775 bp, Homo sapiens
ctctgcctcccaggttcaagccattctcctgcctcagccatccaagtagctgcgactacaggtgcccgccaccatgcccggctaattttttttgtatttttagtagagactgagtttcactatgttggccaggctggttttgaactcctgacctcaagcagtctgcccacctcggcctcccaaagtgctaggattacagacgtgagccaccacacccggcctctgaaaccctttctgatccagtagaagttcgtctctgtttcttggctattaaatgtgtgggcctcagagccaaactatatcaagatcctagatttttcctgaactccctaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431900 - DNA, 1589 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431901 - DNA, 1799 bp, Homo sapiens
tcgactctaaggatcccccattgatgcccctgtgatcgtagggatggcgagggcgatgaggattagggtgatggcgggcaggataattcagacggtttctatttcctgagcgtctgagatgttggtattagttagtattcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431902 - DNA, 2092 bp, Homo sapiens
ctgtgagtttcggcaacggagcccgcccctgtgagcctcagtttcactcggagatgattgtgtctgcctcgtaacggtgattgaggatgaaatgaagtgctctacaagtgtttgcccgtaatatattcttagaggcccctgggatgctctcaaaatgttgattcccgggacttcttcacactcctcttggagaaacagcctgtcctgagctccagtcgttatcacctttggtttcagttgccacagacagcactgtgagatcttcattctaccttattttcattttatggttgaaaaaactgattcagaagggtgaagtggctctcccatggtcaaacagcctacctctctgcgtttcttcaataaatctacatttggagttgggatcagagctcttgctgggtcaatttcactgtgtatgtgggccagactagcagtaatcagggaaggcttcttgggagaggaagttgcggggggacgggagggaggtgccaggaacccctcagccctcacatctgggagccagagacagaaaagagtcctgttttgaaggaggagtgtatcccagaaggtcccagtactgtgtctcactggtactagctatgggcctcccatctccaggtgtctttttttttttttttttttttttttcagttgagatgaagtctccctctgtagcccacactagaatgcagtggcttgattttggctcattgcaacctccgcctcccgggttcaagcgattctcctgcctcagcctcctgagtagctgggactacaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431903 - DNA, 1373 bp, Homo sapiens
cgctagtgagggcgcgggttaatcggcgaggcggaaccgcgagcataggcgcagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431904 - DNA, 1426 bp, Homo sapiens
aaacaataggctaggtacgtggccgtgatggttaatcagacacgatggaccggacgcgggcgccatcccggaagcgcgagcaaggcctgccagactgtgcagtgcatgctggatggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431905 - DNA, 1493 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggtgccgccgctaccgacgccggggccgagtttggggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431906 - DNA, 1318 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcggaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431907 - DNA, 1295 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccaccccgtcgggtggagcgctccacccgacggggtgggagatgatgcgcttgagcctgcgctcctgcaccccaggggcgctgcgctggctctggtcgtgcaagcccaggaaggccgtccactgcgtggggtctgagtaactgaatcctctgtcatcgatgtagcagtgtgcggcagag

SEQ ID NO: 431908 - DNA, 1117 bp, Homo sapiens
  misc_feature (1074)..(1074): n is a, c, g, or t
  misc_feature (1083)..(1083): n is a, c, g, or t
  misc_feature (1106)..(1106): n is a, c, g, or t
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccgtcagcaaccccatncgttcttgnccccgcgcccacaaacgggtacnctgagctcgaa

SEQ ID NO: 431909 - DNA, 1233 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggagtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431910 - DNA, 1164 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccaggcccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431911 - DNA, 1021 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431912 - DNA, 1155 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcggaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccaccccgtcgggtggagcgctccacccgacggggtgggagatgatgcgcttgagcctgcgctcctgcaccccaggggcgctgcgctggctctggtcgtgcaagcccaggaaggccgtccactgcgtggggtctgagtaactgaatcctctgtcatcgatgtagcagtgtgcggcagag

SEQ ID NO: 431913 - DNA, 2376 bp, Homo sapiens
gtggagactgggtgtctctgcatggcatgtcataggagttcaataaccatagttattattagagggaagggggttttgctgggtgtggcaccttatttctagaaggtgctgcaaaccactgaccagatacagatcacaaatagatgctcttggcctccatgatatcttggaaaaaagtattgattgctgacatttgtcaatgaggcaatttcccagaaaaaaaaaatccctgtttcctttttcctggagaaacatcagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatcgcttgaacctgggaggcggaggttgcgctaagccaagatcgcgccattgcactccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagacccctctgccatgccagggcacgcccattccagctggagtcgtggggctgggcacaggggaatttttccagagctgagcctgacgtctgctctgaagaatgcttagaaggttccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431914 - DNA, 2286 bp, Homo sapiens
gtggagactgggtgtctctgcatggcatgtcataggagttcaataaccatagttattattagagggaagggggttttgctgggtgtggcaccttatttctagaaggtgctgcaaaccactgaccagatacagatcacaaatagatgctcttggcctccatgatatcttggaaaaaagtattgattgctgacatttgtcaatgaggcaatttcccagaaaaaaaaaatccctgtttcctttttcctggagaaacatcagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatcgcttgaacctgggaggcggaggttgcgctaagccaagatcgcgccattgcactccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcagatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431915 - DNA, 2390 bp, Homo sapiens
gtggagactgggtgtctctgcatggcatgtcataggagttcaataaccatagttattattagagggaagggggttttgctgggtgtggcaccttatttctagaaggtgctgcaaaccactgaccagatacagatcacaaatagatgctcttggcctccatgatatcttggaaaaaagtattgattgctgacatttgtcaatgaggcaatttcccagaaaaaaaaaatccctgtttcctttttcctggagaaacatcagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatcgcttgaacctgggaggcggaggttgcgctaagccaagatcgcgccattgcactccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggcttcactgcgcacttaagtgtctgggacaattccaaccctgggataaaatcttgacgacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431916 - DNA, 1655 bp, Homo sapiens
ctgtgagtttcggcaacggagcccgcccctgtgagcctcagtttcactcggagatgattgtgtctgcctcgtaacggtgattgaggatgaaatgaagtgctctacaagtgtttgcccgtaatatattcttagaggcccctgggatgctctcaaaatgttgattcccgggacttcttcacactcctcttggagaaacagcctgtcctgagctccagtcgttatcacctttggtttcagttgccacagacagcactgtgagatcttcattctaccttattttcattttatggttgaaaaaactgattcagaagggtgaagtggctctcccatggtcaaacagcctacctctctgcgtttcttcaataaatctacatttggagttgggatcagagctcttgctgggtcaatttcactgtgtatgtgggccagactagcagtaatcagggaaggcttcttgggagaggaagttgcggggggacgggagggaggtgccaggaacccctcagccctcacatctgggagccagagacagaaaagagtcctgttttgaaggaggagtgtatcccagaaggtcccagtactgtgtctcactggtactagctatgggcctcccatctccaggtgtctttttttttttttttttttttttttcagttgagatgaagtctccctctgtagcccacactagaatgcagtggcttgattttggctcattgcaacctccgcctcccgggttcaagcgattctcctgcctcagcctcctgagtagctgggactacaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccaggctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431917 - DNA, 629 bp, Homo sapiens
tttacttttccctttttagtaatggtattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaaaaaacctagttg

SEQ ID NO: 431918 - DNA, 593 bp, Homo sapiens
gccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcagagacgggggtttcaccatgttgaccaggctagtcttgaactcatgacctcaggtgatccaccagccttggcttcccaaagtgctgagattacaggcatgagcacccggtccagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatgataacagtatgtatgagcttgatgctttgtttagcatagagtagctgctgaataaatgggagagtacattaagtgagctctgaaaccctttctttctctttcctttctttctctctttctctgtctctctctcttt

SEQ ID NO: 431919 - DNA, 387 bp, Homo sapiens
ttgagatgaagtctccctctgtagcccacactagaatgcagtggcttgattttggctcattgcaacctccgcctcccgggttcaagcgattctcctgcctcagcctcctgagtagctgggactacaggtgcccgccatcatgcctggctaatttttgtatttttagtagagacgggggtttcaccatgttgaccaggctagtcttgaactcatgacctcaggtgatccaccagccttggcttcccaaagtgctgagattacaggcatgagcacccggtccaggtatcctctttatacaagatcatgcttctttgggaatgtggagactgggtgtctctgcatggcatgtcataggagttcaataaccatagttattattagagggaa

SEQ ID NO: 431920 - DNA, 308 bp, Homo sapiens
gcgggcacctgtaatcccagctacttgggagggtgaggcaggagaatcgcttgaacctgggaggcggaggttgcgctaagccaagatcgcgccattgcactccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaa

SEQ ID NO: 431921 - DNA, 1980 bp, Homo sapiens
  misc_feature (921)..(921): n is a, c, g, or t
cataactccaccttttctacaattcagtggaaccaatttaatcaaagtgccctacttagggagaacattgctagaaatgacagggattgggaaaccatatggtgcttggcagaggacccgaaaccaatgtagaaactgaggagcttgggcaaagtgtgtcatttatcgttctggggctagggctgagtcaggtccaagaactgaccccctctcagagctgggacttcatcaaggctttggctctggtttgaacgtggtacttgcaggctcttgtcgtagcaccgggagactcctctcccagcaactcaggactcctaggaccagtgaggcctgtgctatcataatgaattatgagtggatccatctgacctataacaaataccacccataaacaacactgcggtgctaagcaaaaatgcctgaagaccatagacagagagaatgggatttttaaagaaacatttataaatagaaatcaaaacatgtgaagctcagaatgaatttgggaaacatgatgggaactgggattcactgagcacgtgctgcactaggtcaagggcagagtgtcagggtgtggcccaacatcaggcgcatgggctctccaggccactctgcactgaagcaaattgcgccattctgtatggtgcttgttcatacacactgcccacagggctctaataatttagaggcactggactgagctcctgagggcaggagcattcatctctgtggccacatgtttggtccagtgtctgacaaataacattcaacttgtaggaacaagtgagagcagagcatcctttctcaggaacaaggcccatcccctggtgagctgctccactggagtcccaggtccctaacctgtggcctaggtagaccttaggatttgcctcactgatgccaatgagttgctgctgcttncttttgaaacaaagtgttggcatgttccagctgctgcgattcaattgcctttcagacagtgtggtgcccaacaaagcatccgtctcaacaccccgcggcctccccagctgccactagtagcaatccattacccacaggcagctcaacaactcaatgtgacttgggctccacgcctctacacaaaagatgcttccctgccctgttctcctccttcctgttgtgaaagcagcctcccttgcccttacccagctgtggctctctcagcggcttcctctagccccaaaggcctgctcagaataaggacctgcacacaagttgtgtggccctgggcaaaacctggagctgcttgatgttctgagcctgctttcaaatctgcaaaatagtgctctctgccttactccctcgcaggctcgtgtgaaggtcaaaagagaactcctgggaaagagcttagtcagctgaaaggctctaaacaaatgatagttattacatcgtcctctgtctccccatgcaagagaccagaacaaaacaatatacaaaagagagagaaaatcccacacctcttggtaactggaaaggctgaggccatgggtgagagcacctcccatttccctgggaaaggagaataagtaaaacttgaattccttcaattagagactcatctaagaatcctttctatcttcccactctgttttgaagtaggacagggggcccagcatcacagacgacaaggttcttaccttgtagttctggtctcatttgtttctgtatttatcaagcctggtacataaacacagtaggtaggtggatggatgaatttgctgtccggtcaagacttcagctagcacattcctaattgacctgcctttacatatatggtttctaaaacactttcacactgggatgatgacagagttctggagatggatggtggtgatggttgcacacactattgggaatatacttaatgacgttgaattgtacatttttaaatggttaaaattgtaaattttatggtatgtatattttaccacaataaaaaattttaagaagaaaaaatgt

SEQ ID NO: 431922 - DNA, 3417 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcactcattcattcaacagatatacttcaggcacaactctgtgcaaatcatttatttaacaaatattgttaaaattctgtggcaattattgttctagtggctgggtacagcaatgaacaatgtagatacaactttctgcctttttggagtttatattctggtgggtgac

SEQ ID NO: 431923 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 431924 - DNA, 333 bp, Homo sapiens
ccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccgggg

SEQ ID NO: 431925 - DNA, 598 bp, Homo sapiens
cccgggcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaaggacctgaccccaccccccggagggccccgcccgtcctttcggttaggagggctggggggttggaatcttgcccccccccttctccctctggggggggggggcgccccccaaaac

SEQ ID NO: 431926 - DNA, 794 bp, Homo sapiens
aaggctagtacgagctggtgtgaatcggccgagggagtcccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgaagccttttttttaaggcgccccaggcccgcccgcgagtcatggggaactccg

SEQ ID NO: 431927 - DNA, 964 bp, Homo sapiens
acattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctct

SEQ ID NO: 431928 - DNA, 423 bp, Homo sapiens
acattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431929 - DNA, 124 bp, Homo sapiens
tttttcttttcattattaataacgattgaaattaactggtatttccacacccatccactcacctcccattcccagccacatggcagagaaaaaaatcataataaaatggctttattttctggta

SEQ ID NO: 431930 - DNA, 1652 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431931 - DNA, 1881 bp, Homo sapiens
  misc_feature (1881)..(1881): n is a, c, g, or t
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtaaaaacaacacaaacaatgctcacatatacatcaactaacgactaacagcagagcaagaagatcacagcgcagcatttcatgcgagggcagcacaaaagaggtccttcaatactagccacatgactgcccacgcgagtttcgcgaccacaccagctgtagctacgaacgggatagtttcgccgaggcccccacatgaggggcgcagctacgcgaacgagcggttctgttn

SEQ ID NO: 431932 - DNA, 2011 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtaaaaaaaaaaaaaaaaaaaaaaaaaaaaaaaaaaaaaaaaaaaaaaaaaaaaaaaaaaaaaaaaaaaaaacaaaaacaaaaaaaataaaaaaagaagaaaagaagaaaaaaagacaaaaaagaaagcgaggagggggggagccgcagaaacagaaccgacgcggagaggcggccacagaagatgagacacccagcgcgctgtagagggagaggagacgccagccagagagaggagaaaaaaaaaaaaagcgcgaggaggagcagaaaaaacaacacacgagggaggagggaacacgggccagaggggaacaggggggagtcaacaacggggggggaggaaaaggggaaaaccacccgaga

SEQ ID NO: 431933 - DNA, 2193 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctct

SEQ ID NO: 431934 - DNA, 1631 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431935 - DNA, 1756 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431936 - DNA, 1619 bp, Homo sapiens
  misc_feature (22)..(22): n is a, c, g, or t
  misc_feature (24)..(24): n is a, c, g, or t
  misc_feature (30)..(31): n is a, c, g, or t
taagcctaggctggtacggtcngngatttnnggatcccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431937 - DNA, 1902 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctct

SEQ ID NO: 431938 - DNA, 1361 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcctccagcagggtcagccattcacacccatccactcacctcccattcccagccacatggcagagaaaaaaatcataataaaatggctttattttctggta

SEQ ID NO: 431939 - DNA, 1498 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccagccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431940 - DNA, 1452 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccagggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431941 - DNA, 1460 bp, Homo sapiens
  misc_feature (1423)..(1423): n is a, c, g, or t
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccagggagggagcctggtacccaccgcacccggccggcgggcccgaccctgccctcacggctgaggagtggctggggggtcgggatgctgggcccctcctcatctccctcaaggatggctacgtacccccaaagagccgggagctgagggtcaaccggggcctggacacccgggcgcacggacgggcacgcanccatgaggcgccaggtaggcacctcccccggctcccg

SEQ ID NO: 431942 - DNA, 1268 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagccatgctgacggccaaagcgacgtccgggctgtccccccggggcgaccttcccggtggaggctgggcggatggcct

SEQ ID NO: 431943 - DNA, 1620 bp, Homo sapiens
  misc_feature (1)..(1): n is a, c, g, or t
naccacctacccccacgcacaatcacccatctcctaacaccccgccaaaacaccaatcggctaggtagcgaggctgggtggcgccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431944 - DNA, 1253 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431945 - DNA, 1163 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431946 - DNA, 2842 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggagccagccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431947 - DNA, 1745 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431948 - DNA, 1810 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431949 - DNA, 1528 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431950 - DNA, 1140 bp, Homo sapiens
ttgaggactctcagaggcacaaggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431951 - DNA, 1839 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggagctgggagaggggctctaggatgggatctgacatttggagtcctgaagactcactggcccctcctctgcggtgtgggagatcccggatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431952 - DNA, 1152 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctaccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431953 - DNA, 1140 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctgcacctcatgggacacacgggcagcagggggatactgag

SEQ ID NO: 431954 - DNA, 1312 bp, Homo sapiens
tcagctcggtaccattctaactatattcaaaactattcatttaaaaattggaatatattgactacatactttaaaagacttttttataatgggaaactttgaacataggcaaaaatagaataatagaaaagcccagcgtgcgacatcagtgtcaacagaggtccatatgtggccagtcttgtctcagccttttccccacccattcactcctctcccaaatccggatggttttaaggtgattttagccatcgaattccatatgactctgttctcaagtgtactggatacattcttgaaaatactcttgaacatattcttgaggatgagaaattcttacaaatgtatattttttgtgcccctgtgtctccccttccttgcctttcaaactcctctctctgtccctttgtctcctttcccccacccttctctctccactcccgggagtggagagagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 431955 - DNA, 948 bp, Homo sapiens
ataggctagtagaggcatgcgcttaaatcggcaccgaggctgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggccctggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacactgtgaactgggatcctctaagtactagccag

SEQ ID NO: 431956 - DNA, 5418 bp, Homo sapiens
cagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgta

SEQ ID NO: 431957 - DNA, 5362 bp, Homo sapiens
cagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctagctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgta

SEQ ID NO: 431958 - DNA, 396 bp, Homo sapiens
ttctggggtgttactcaatacaacttttaaattgatttacttttattcattgtctttgcttttatttgcagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtacgtactttccttaactttgtcatgtaattattccactgttcttttaatttggaaatctttcagctataggttgattcttctgaaatagtttggaagggcctttatcttctaagtaggatgtactagatcacagcaagccaaactcctgctacaacaaacttgaaaaagtacgtaaattaaaa

SEQ ID NO: 431959 - DNA, 5532 bp, Homo sapiens
cagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttgctgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 431960 - DNA, 2402 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaa

SEQ ID NO: 431961 - DNA, 808 bp, Homo sapiens
tcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtctccataaaccatgacctacagatttgacccacaatgaccagcatgtcccttatggacattttctaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggtaggttttcagaggaaaattcttttatcaacatctgtataaaagaaatgatgaggcagaatttgggccctttgaaaaactctccagtgcattgccacatgctcccaagtggactgagtcccttgagagtcaagacgtggtcttataaattttatgtcccctaaaattgtactacagtcttctgcatatagtagatggtccataaatatttatggacaccgtgg

SEQ ID NO: 431962 - DNA, 3703 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431963 - DNA, 3951 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaacaacaacaaacaaacaaaaaacaaaaaaacttgtggtggggcgcggcctggggccctgagaaaaaggacttttaaaaccatcttggtgggggcgcgcgggggcgccaagtgtggtgattggcaaccgtgtgacactaacgcggggtcgcaaaggggaaaccgcgggcacacaaagtcggggtggtgctcctccccaaataaaaaaacgcgcgggggaaccggaccgctccggagacaatcag

SEQ ID NO: 431964 - DNA, 3780 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttagaaataatcatttgttctaagcatggtactagagcagaagattatttctatgtacaactgatgcttgttcttattttaataaatttatcagagtgaaaaaa

SEQ ID NO: 431965 - DNA, 3650 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaattcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431966 - DNA, 3649 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataatttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431967 - DNA, 3636 bp, Homo sapiens
cctgcaagcctcagatgattgtactggttactgaatgggttgacctctctctagtagatagacgtgcaatggacacatagagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431968 - DNA, 3633 bp, Homo sapiens
tcccaagagctcttccagacccgccttttcttctgtagggtctcggagcagatcgagctgactcccgttctgccaggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431969 - DNA, 3649 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaagaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431970 - DNA, 2956 bp, Homo sapiens
catgatttaaaactcaacccacttttcacatatgctccacttgctttgggaagcccttcaaggacttgtcattatagaatctagagaaactggtgcagctaacacaactacttggatttgggtcttaatgcttcttgaaggaaatgtttggaaggggcattgtgcacatttgattcatgcttcaaggatggcacaccttatatctagttttcgtgcatcacatggctctttccacagatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431971 - DNA, 2462 bp, Homo sapiens
tcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtctccataaaccatgacctacagatttgacccacaatgaccagcatgtcccttatggacattttctaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431972 - DNA, 1147 bp, Homo sapiens
cagttacacggtgacttttaatagcatacagtgtaactggagttacattattcacagaggccattaagacttctcttattagacaatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaa

SEQ ID NO: 431973 - DNA, 2055 bp, Homo sapiens
  misc_feature (1)..(1): n is a, c, g, or t
  misc_feature (3)..(3): n is a, c, g, or t
  misc_feature (6)..(6): n is a, c, g, or t
ncncgngggtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtgagcaattcccagagctgggctttgagactcaggaattcagactcagactttacatagaagagtaaatgagtctctgggatcctttctgtttcctcatgagcagattctggaatgttctggtgtctcttctttatctagcttaattatgtttccacttagtatttgaaaagtgctagaaggccaggcgcagtggctgtcacctgtaatcccagcactttgggaggccgaggtgggcagatcacaaggtcaggagttcgaggccacctgaccaacatgatgaaaccctgtctctactaaaaatacaaaaattagctgggcatagtggcatgcccctgtaatcccagctactcgggaagctgaggcaggagaatcgcttgaacctgggaggtggaggttgcagtgagccgagatcatgccactgcactccagcctgggcaacagagcgagacttcgtctc

SEQ ID NO: 431974 - DNA, 4211 bp, Homo sapiens
  misc_feature (3790)..(3790): n is a, c, g, or t
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431975 - DNA, 2830 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggt

SEQ ID NO: 431976 - DNA, 4515 bp, Homo sapiens
  misc_feature (4094)..(4094): n is a, c, g, or t
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431977 - DNA, 3727 bp, Homo sapiens
  misc_feature (3306)..(3306): n is a, c, g, or t
ttgtgcatgtgtttccttccccaagagagctataaacagcaaaaattctgctgtaagcttccctgtgtcctctctgcgtttggcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431978 - DNA, 2757 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcggagagatttagagtcctggaggcagcct

SEQ ID NO: 431979 - DNA, 2826 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctgagcaagccaggcctggcttgctcaggtctccaggtctgcctgtttgaagatgaaaaataatacccatttaaaatttgccctactcaatttccttctcagtcacattttaacttttaaacagctaatcactcccatctacagattaaggtgtatatcgcccccaaaccttttgccaccttaaaaatttccttcaaggttaaactaccgcatttctcatcatgattcgat

SEQ ID NO: 431980 - DNA, 3637 bp, Homo sapiens
  misc_feature (3216)..(3216): n is a, c, g, or t
gaggtgagcagctctgggatcactctgcaggaaaagaatagagggagaaagatctcagaggacccgaaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431981 - DNA, 2944 bp, Homo sapiens
  misc_feature (2523)..(2523): n is a, c, g, or t
tgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431982 - DNA, 1931 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttgtgcaacccgggccggcca

SEQ ID NO: 431983 - DNA, 3248 bp, Homo sapiens
  misc_feature (2827)..(2827): n is a, c, g, or t
tgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatccttaggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctttctttcnctctctctctctctctctctctctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactccggatccgcat

SEQ ID NO: 431984 - DNA, 2347 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggcttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaa

SEQ ID NO: 431985 - DNA, 1411 bp, Homo sapiens
aattctctgtctgtccctcggctctggggagaaagggggggctgtggcgtgggggctgaggaggggctaaggcgggaggggcgcctcatcccttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggatcgctgctcgggtccccactttggcgaccgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcagaacacccctgattagccaggcccaccgccatccacatctgctcggcaaagaaggaaggcagcttgttccagaccttggtgagcagctgcagactgcctgcctagaacagcctccttactccagcctggcagggaaggaaggaacctgacttgcttcgcaggatctggaagctcagccggcagagctgagagccgcagttgcatcctggagcctgatgctagaagcagcttccgtctttgggttcttgctgcctcggcctctgctctgttcagtttgctgttgtgtttttctcccccatgttggggtggtggggtacagggaaataaaatgctttctcccaggcccctaatccttccccatgcctccatcagcctcaaagctgctgacagtcatgaactgcaccttccagccctgcccataagctactcaaagcaaattcaaattctcttctggccaggaggaagggcagatgctccctccttcctcaagcctccctggctcattgatccattttgagggcatttgggggtcaaagttgagaccagattgcttcagtttgtataaaattagcatttcttatcacaccaaggccacacctgttctctggcctcacaaaccagtgaggatgtaaaggtttgttgaggtggaggaacagaagtgaaatgagcaatctgctccatttagaagtcagtcgcttcggctgttcattccactaatatttatctagtacctattctgtgccaagcattgtctctacctcagtttgccacaaatatgaaaaaaaaaaattcttggaactgtgaggcttcaatgtgttgtggaccaatatacaaataaaccaatggaaaagaaa

SEQ ID NO: 431986 - DNA, 1618 bp, Homo sapiens
aattctctgtctgtccctcggctctggggagaaagggggggctgtggcgtgggggctgaggaggggctaaggcgggaggggcgcctcatcccttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggatcgctgctcgggtccccactttggcgaccgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcagtcgggaccgattaccagcctagaaaaacccagccgcgtcccaaacccgctcaccccagcaggcccttagagacgcttggagatccccagacacgccccgcggaaagacaattcttccccactcccagccatctgcaaaccacagtcagcctgtccctgctcccaaaaatggaattgctgatgccctcaaggctgttactctcccaggaacacccctgattagccaggcccaccgccatccacatctgctcggcaaagaaggaaggcagcttgttccagaccttggtgagcagctgcagactgcctgcctagaacagcctccttactccagcctggcagggaaggaaggaacctgacttgcttcgcaggatctggaagctcagccggcagagctgagagccgcagttgcatcctggagcctgatgctagaagcagcttccgtctttgggttcttgctgcctcggcctctgctctgttcagtttgctgttgtgtttttctcccccatgttggggtggtggggtacagggaaataaaatgctttctcccaggcccctaatccttccccatgcctccatcagcctcaaagctgctgacagtcatgaactgcaccttccagccctgcccataagctactcaaagcaaattcaaattctcttctggccaggaggaagggcagatgctccctccttcctcaagcctccctggctcattgatccattttgagggcatttgggggtcaaagttgagaccagattgcttcagtttgtataaaattagcatttcttatcacaccaaggccacacctgttctctggcctcacaaaccagtgaggatgtaaaggtttgttgaggtggaggaacagaagtgaaatgagcaatctgctccatttagaagtcagtcgcttcggctgttcattccactaatatttatctagtacctattctgtgccaagcattgtctctacctcagtttgccacaaatatgaaaaaaaaaaattcttggaactgtgaggcttcaatgtgttgtggaccaatatacaaataaaccaatggaaaagaaa

SEQ ID NO: 431987 - DNA, 675 bp, Homo sapiens
ccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgcccagagcggtcccctgctgtcctgggcccttacgttgattctaagttaggagtgatctgagagagggaataactcccaaaaatcttttttttttt

SEQ ID NO: 431988 - DNA, 3105 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431989 - DNA, 1616 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacga

SEQ ID NO: 431990 - DNA, 1407 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacga

SEQ ID NO: 431991 - DNA, 960 bp, Homo sapiens
agcggcagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtattttatgcatggggtttgtaaggaaggagacaactgtcgctactcgcatgacctctctgacagtccgtatagtgtagtgtgcaagtattttcagcgagggtactgtatttatggagaccgctgcagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacga

SEQ ID NO: 431992 - DNA, 550 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggcagaggtctctgtattttgcagctgcccttttgtaagaagcacttttcccaaataaaacaattaaaaaaaaagttggctgttctgtgtaa

SEQ ID NO: 431993 - DNA, 3855 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431994 - DNA, 3038 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431995 - DNA, 2994 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaacaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431996 - DNA, 3143 bp, Homo sapiens
agcggcagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtgggctggctcctcccctgccgctggaaggatgcccccgccgctgcctccggctcccggggctcgggaggtggtcacttgaggccggtctcccagcgatcctctccgggcctagacaccccgccgagggccccagcgagcttgcctggctcccggccctctcctctctccgtgccatccgtttgtaacgtcttttcacgtccctccgtccctccgccccccatcctccgcccaactgtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431997 - DNA, 2906 bp, Homo sapiens
agcggcagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431998 - DNA, 3801 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 431999 - DNA, 3818 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 432000 - DNA, 3871 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaactcttgcaaactagatatagaaggtaactttcttaacctggtaaagagcatgtattaagaaaaaaaa

SEQ ID NO: 432001 - DNA, 3801 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcatcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 432002 - DNA, 2522 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgaggtatgagcactgcagccttttctcaagcgaagagcccaacagagcttgggttcactttgaaaagaatggtgctgcattatacactcctacctccttcctacccttctttgacttcccaggacagtttattttgtcaccctgataacatccagtatatatcttgctataacacagtccttggggtccatgccaagggactgtgttataaagaggtctctactgttgacaagtaaggccccatgagtggggttctaccttattctgaatccgtgtcatagctgtcctatgttctcatgtgttggctttctagaagattttctctctatggcatctgcttgtactagagctattaaccagcatagacttgaacagagttaccggtttctagttagtgtttcttgcattggcacacacatgtttataagaacacatcttggggagggctgtaagctgacatactggttctatccctacctgtttaaagaaaccccggatgatagtca

SEQ ID NO: 432003 - DNA, 1652 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccaaatttaaggagaaagtcagaataatttttagaggaaagggtggggaaggcccctgggttgggtcccaagtctttttcccaaaaa

SEQ ID NO: 432004 - DNA, 1772 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgaggtatgagcactgcagccttttctcaagcgaagagcccaacagagcttgggttcactttgaaaagaatggtgctgcattatacactcctacctccttcctacccttctttgacttcccaggacagtttattttgtcaccctgataacatccagtatatatcttgctataacacagtccttggggtccatgccaagggactgtgttataaagaggtctctactgttgacaagtaaggccccatgagtggggttctaccttattctgaatccgtgtcatagctgtcctatgttctcatgtgttggctttctagaagattttctctctatggcatctgcttgtactagagctattaaccagcatagacttgaacagagttaccggtttctagttagtgtttcttgcattggcacacacatgtttataagaacacatcttggggagggctgtaagctgacatactggttctatccctacctgtttaaagaaaccccggatgatagtca

SEQ ID NO: 432005 - DNA, 1438 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctggattcgcgggcctggcacagctcgcggctctgctgcccgctgcggcgccccttgcgcacgttctcccctcttccgcagcccacgcgccccacccccccgcccccctccgcccccgcccctggccctgccagaccccctcccatccgcccccgctctccgcccgcgctcccccccccccccctccccccc

SEQ ID NO: 432006 - DNA, 1338 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaatgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 432007 - DNA, 1225 bp, Homo sapiens
gttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcagaggtctctgtattttgcagctgcccttttgtaagaagcacttttcccaaataaaacaattaaaaaaaaagttggctgttctgtgtaa

SEQ ID NO: 432008 - DNA, 489 bp, Homo sapiens
ctcgtgcgaattcggagaggagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaa

SEQ ID NO: 432009 - DNA, 301 bp, Homo sapiens
gtaaggaaggagacaactgtcgctactcgcatgacctctctgacagtccgtatagtgtagtgtgcaagtattttcagcgagggtactgtatttatggagaccgctgcaggtaagaatttgtttataaatttgttcaggggtgggttggaggaaaaaggtaaaagacatacttctgatagctttatatgtcactgattaaaaataatgctttgaaaatgactcttggctgggcagtggctcatgcctataatcccagcactttgggatgcttaggtaggaggattgcttgatcttggaagtt

SEQ ID NO: 432010 - DNA, 782 bp, Homo sapiens
atggaaaaaaaacttagagtaaaacaggaaagaaagtggcgagctttttccaggaggaagaaacctgttgggaaaatactagatacttcatgctggagaaggaattcaatgaaataaacatgataaaccctttactcatagagcgacactccaggacatgtgaggattaatgctgtataaaacactcactaagagaaaagcaacttgttacaatgaaaaaaaagaaaattattaaaaaaaataataaaacactgtcaatgtcctgaattagggaaagtatttggtgattgcacgtaccctcatgaaccttaaagttctcatgttggggaatctcctcaagtcagtgtaagtctgtttcagcatgctagagtatcaagatgaatgcatgaaatttcattatgtatttgtattttctttataggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432011 - DNA, 1160 bp, Homo sapiens
caccaatccctgctgccgttgtcaaggaaatcttttctccatgtggagcctcagtttgaatcctggttttggcatgttctgttttaagcccctcataatgcaagttattaatatgttttaagtctaaactccttagaacaactagttatgccctaggttctaggaattacaaactactttttaaaaataacccagcagcctaaatgaaggtttaggtttgacagctcttactgctaagtccaagaacagctctctgagtcacttgagcatgtgcagaaacagtcacgccctgatggttaaacttagtcccagtcctcctgattagcctaacatagaaccagtttaatcttaaggaaataaaagtgctaaaggaagagttattttaaaagctaactcctaaagttgcagacatttctctggaagattcttggggtatcagaccaaatcagtattctcaatcctgtcttaaaatgtataatcgctgtactatacaactctaagcagtaatatatgtgtgtgtgagctcacatgtaaatgtataatatagccacccatataatcaacttcctgtgggggtaataatccctttacctttctctggaaccagtttcaaaattttatagttactaaatgtgttttccttcccaacctacctacttcaagtttacaaaaatacagacaaggctgcatgcagtggctcacctctgtaatcccaacactttggaaggccgaggtaggaggattgcttgaggccaggagtttgagaccagcctgggcaacatagcaacatgccatctcctacaaaaaaataaaaaaatttgctgggcatggtggcataacaacagtccccagctactcaggagactgaggcaggagaatcacttgagcccagtagttcaaggccgcagtgagccatgatcacaccactgcactccagcctgaccaaaagagcatgaccttatctcaaaaataataataataaacgtcttgtacatgctaatatttgtgctgtatttcagggagcagttttgtagaactgagagggaatttgtagatcatgtagtctaggtttcttctcactttctatctctcacccccaatggccagtggctgcctcaagtgaaaaaataagtgtcctgaaatcaagcacaagcccagca

SEQ ID NO: 432012 - DNA, 569 bp, Homo sapiens
gcggccgcgggctcctcccccggcgcctccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacaggtgcgtgcgcagtctgggagggggctgctcagccgctgggggccggaccgcgccggggacttgcggagggaagcggaaatacttgcggtgggggcgactgcacttccgggtcggtgtgtccctggcgaagcttgagcctgctagccagcggtgctctgcgttcccggggctggagcagcggcccatagtggcttcccgggttcatccctcgctgaccctgcgccacggaagccctagccccggaggtcgctggtatttcctcgcacgcggacccttctggggtgcgtggggaacaggcagtttgctgcctcggcccggctggtccctgcaaaccccaaagaatttcaacagagacacttgctgggctctcgctcggctttcagccttgcgcaaacat

SEQ ID NO: 432013 - DNA, 514 bp, Homo sapiens
tttacatttcataaagtagttgagattatgatctacctaactgtcacaaatcccctcccgcaaatgaactcttccatttgtctccctgaactggccagagaaatctgtggatgagaggaaagtttatctgggttttcctacattcactcaactaagtattagtgactattatcaacacctggcttctttacaaagagaagaaattactggaggtgcagaagcaaaagatgcacatcctcatttgacctcccttctcagtttcaaggctgagcatgcttcctgagcagacgccttcctcgggatgcctggagcccatgaggaatgcagtgacctaacgctcccagaacacaataatgagaccccaacttaagtttcttgcccaaagaaggagcccataaattgagtcaggtctcaagagaatcatacaacaaagcagattgtgcacaacaatgccgctgcctatcactcagcctcagtcttctaaaaaagaaaaaaagtgagtgctctctctctc

SEQ ID NO: 432014 - DNA, 1226 bp, Homo sapiens
aactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432015 - DNA, 2009 bp, Homo sapiens
gcggccgcgggctcctcccccggcgcctccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacaggtgcgtgcgcagtctgggagggggctgctcagccgctgggggccggaccgcgccggggacttgcggagggaagcggaaatacttgcggtgggggcgactgcacttccgggtcggtgtgtccctggcgaagcttgagcctgctagccagcggtgctctgcgttcccggggctggagcagcggcccatagtggcttcccgggttcatccctcgctgaccctgcgccacggaagccctagccccggaggtcgctggtatttcctcgcacgcggacccttctgggaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432016 - DNA, 1728 bp, Homo sapiens
gcggccgcgggctcctcccccggcgcctccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432017 - DNA, 1666 bp, Homo sapiens
gcggccgcgggctcctcccccggcgcctccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagagtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432018 - DNA, 990 bp, Homo sapiens
  misc_feature (930)..(930): n is a, c, g, or t
  misc_feature (934)..(934): n is a, c, g, or t
aactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataacagttcnatanagccgtcaacaagaaaaccccttcttttacctccccattgctgtagaaatgggtac

SEQ ID NO: 432019 - DNA, 1603 bp, Homo sapiens
gcggccgcgggctcctcccccggcgcctccgctatctgggtcaggacgcgacggccgcggcgcgggaccttaggacccgcgggctccagggctactgtccgtccgccactgcgcgccagcaggtcctggtctccgctctccaacagctgaaaggccggcgcagtgaacacaggtgcgtgcgcagtctgggagggggctgctcagccgctgggggccggaccgcgccggggacttgcggagggaagcggaaatacttgcggtgggggcgactgcacttccgggtcggtgtgtccctggcgaagcttgagcctgctagccagcggtgctctgcgttcccggggctggagcagcggcccatagtggcttcccgggttcatccctcgctgaccctgcgccacggaagccctagccccggaggtcgctggtatttcctcgcacgcggacccttctgggaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtcttcaaaaactgaggtggattgcgaaacaacatgggcggtactctgttggaaaaatccattcttaatgtaccagaagttacacaattttcttaaggtgagaaataggccggtgcgttaatcccgttcgtggtcttgccacggttacgagtggggaacaaaggttgagctggagggttggccaggtca

SEQ ID NO: 432020 - DNA, 681 bp, Homo sapiens
tgaaaaaggaaggtaaaatattaacatgaataccatgagggtggtatctctaatatatattatttatggatatatgttttcatttgtatatgttatatctatacacacacacacgtatatacacataacacacacacgtctaactggggagagataatccattcaaaaggtgaacaactttctaagagtgatgttgttgtgtatttgcaggtctcaaaactgagctggattgagaaaaaaatggctgctactctgtttggaaaaataccatcttcaactgtacaagaagctttacacaatttccttaaggtacattttgtgtatccattattttagtgtcagactgattaccatctgcaccaatccctgctgccgttgtcaaggaaatcttttctccatgtggagcctcagtttgaatcctggttttggcatgttctgttttaagcccctcataatgcaagttattaatatgttttaagtctaaactccttagaacaactagttatgccctaggttctaggaattacaaactactttttaaaaataacccagcagcctaaatgaaggtttaggtttgacagctcttactgctaagtccaagaacagctctctgagtcacttgagcatgtgcagaaacagtcacgccctgatggttaaacttagtcccagtcctcctgatta

SEQ ID NO: 432021 - DNA, 1741 bp, Homo sapiens
atatgtctacttcatcaatttttcttttctttttatggactcttttctgttggcaaaaaaaacctgttatttcttgatcttttggcaccattttcgcacttaataatggcgtaatttctcttctatttgttttctatttgcccatctgttcttttttctccttttcctgccttcttttggaccaaaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaaagaa

SEQ ID NO: 432022 - DNA, 1085 bp, Homo sapiens
aactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaatactgttttacca

SEQ ID NO: 432023 - DNA, 626 bp, Homo sapiens
  misc_feature (13)..(13): n is a, c, g, or t
  misc_feature (17)..(18): n is a, c, g, or t
  misc_feature (20)..(20): n is a, c, g, or t
  misc_feature (32)..(32): n is a, c, g, or t
  misc_feature (38)..(38): n is a, c, g, or t
  misc_feature (58)..(58): n is a, c, g, or t
  misc_feature (63)..(63): n is a, c, g, or t
  misc_feature (69)..(69): n is a, c, g, or t
  misc_feature (74)..(74): n is a, c, g, or t
  misc_feature (76)..(76): n is a, c, g, or t
gattcggcacggnggcnnantggccgtagganagagcntagctaaatagaaatcatgncatanctgtancactntnctgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432024 - DNA, 892 bp, Homo sapiens
  misc_feature (13)..(13): n is a, c, g, or t
  misc_feature (17)..(18): n is a, c, g, or t
  misc_feature (20)..(20): n is a, c, g, or t
  misc_feature (32)..(32): n is a, c, g, or t
  misc_feature (38)..(38): n is a, c, g, or t
  misc_feature (58)..(58): n is a, c, g, or t
  misc_feature (63)..(63): n is a, c, g, or t
  misc_feature (69)..(69): n is a, c, g, or t
  misc_feature (74)..(74): n is a, c, g, or t
  misc_feature (76)..(76): n is a, c, g, or t
  misc_feature (651)..(651): n is a, c, g, or t
  misc_feature (661)..(661): n is a, c, g, or t
gattcggcacggnggcnnantggccgtagganagagcntagctaaatagaaatcatgncatanctgtancactntnctgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcaaaaaaaaaaaaaaaaaaaaaaaaanaaaaaaacanaaataattaataaatataaaaattaataaatataatattatattatcaatatctattacttcgggtgaaagaataaaaattaattattttattttctttttggggcctcttcgcccaaggcacttttaatttggagaagtttatttggcggggcaaattgaggtcaatttggcaattttcccttatgggggcgattaaaaatacggggcgcggttaaaaagggggggtggg

SEQ ID NO: 432025 - DNA, 476 bp, Homo sapiens
tcacccccaggtagaagtaatccacacagaacttctagaaaaagcgaggcaatttgatgtggcatgagagagaaccctgggggcagtgcatgaccagctgtggtcacctccctctcccatgtataaagagggaacggcctcctcaagtagagtcagctgcctagagtcctgtgtaggcagaggccgtccagcaagcctcctggagctgtgtggccatgagtcaagccacttgaggtggagttgggggttggcaaggattagatctcttctggggttcttcccactctcctcccaccttgcaggctctgggaccgaagccttgtgggaatcctgagggcctctgtgtagaatccttgttttgtctgggcctgctggaggcggagggtgggtgctgccaaactgtgcttggttttccattcactgagttactacttagaataatggcctccagctccatccagttgtgcagtggatcc

SEQ ID NO: 432026 - DNA, 1625 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432027 - DNA, 1602 bp, Homo sapiens
actgcatccaacgccgctgactgcatccaacgccgctgactgcatccaacgccgctgactgcatccaacgccgccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432028 - DNA, 1891 bp, Homo sapiens
  misc_feature (1650)..(1650): n is a, c, g, or t
  misc_feature (1660)..(1660): n is a, c, g, or t
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcaaaaaaaaaaaaaaaaaaaaaaaaanaaaaaaacanaaataattaataaatataaaaattaataaatataatattatattatcaatatctattacttcgggtgaaagaataaaaattaattattttattttctttttggggcctcttcgcccaaggcacttttaatttggagaagtttatttggcggggcaaattgaggtcaatttggcaattttcccttatgggggcgattaaaaatacggggcgcggttaaaaagggggggtggg

SEQ ID NO: 432029 - DNA, 1624 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactctcatgtaactactcgacacgtgatctcggaagagggtggccgtcagcattcaccaaataaacccgctctctgggcaaaaaaaaaaaa

SEQ ID NO: 432030 - DNA, 1571 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432031 - DNA, 1617 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagcgtagtccagaagctcaatgtaaagggtcgactggttgcagttgaaatgacctgaaatgtagcctctgtccttgtaagtcagttgacttgccgaaaatctctttccgtgcgttaccaggttagaccggcccgaaatttgagtgtgaagtagctgaccgcggaaaaatcggagacgggaaaacggtaggggcgagaagatgttttgcccataagagaaggagctcagtttagaagaaccatgagggaaaaaacaatcgagaggatacaatgaagtgagtacagacccggtggataggaaaggtagagtgacagatcgcctcccacatatgtttcagtgtagtgcaaatgtaggatgaagtggcgagagggaaatatatgaggagggttctcgagagatatctcggaggaaggaccct

SEQ ID NO: 432032 - DNA, 1229 bp, Homo sapiens
  misc_feature (915)..(915): n is a, c, g, or t
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtgataaatacgtgatgttatccccnacactagcaaatctaggtcctactaaataccaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagca

SEQ ID NO: 432033 - DNA, 1157 bp, Homo sapiens
  misc_feature (26)..(26): n is a, c, g, or t
gtttcctgtcgactctgaggatcttnaaacaccgcaatctcaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432034 - DNA, 1573 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgtggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432035 - DNA, 1463 bp, Homo sapiens
tcacccccaggtagaagtaatccacacagaacttctagaaaaagcgaggcaatttgatgtggcatgagagagaaccctgggggcagtgcatgaccagctgtggtcacctccctctcccatgtataaagagggaacggcctcctcaagtagagtcagctgcctagagtcctgtgtaggcagaggccgtccagcaagcctcctggagctgtgtggccatgagtcaagccacttgaggtggagttgggggttggcaaggattagatctcttctggggttcttcccactctcctcccaccttgcaggctctgggaccgaagccttgtgggaatcctgagggcctctgtgtagaatccttgttttgtctgggcctgctggaggcggagggtgggtgctgccaaactgtgcttggttttccagagttgtatgttgcagcttttaggcaccaaggagcagtctccctacagcctggagaggagtctggccacagggcagggctgtttgacagacaccatggagcacaggcagccctcatttccggccagaacatgttgaacgcaccagtcatcctaaatagccttttctgtcttcacacagccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432036 - DNA, 912 bp, Homo sapiens
  misc_feature (2)..(2): n is a, c, g, or t
  misc_feature (84)..(84): n is a, c, g, or t
  misc_feature (105)..(105): n is a, c, g, or t
  misc_feature (118)..(118): n is a, c, g, or t
  misc_feature (181)..(181): n is a, c, g, or t
  misc_feature (188)..(188): n is a, c, g, or t
  misc_feature (196)..(196): n is a, c, g, or t
  misc_feature (199)..(199): n is a, c, g, or t
  misc_feature (214)..(214): n is a, c, g, or t
  misc_feature (216)..(216): n is a, c, g, or t
cnccctcaagcctttctccaatgcctcccaggaggatttggggactttctccctggggcgcccagatccagctcggaggcctcnctgggacctggcaaggcctgncctcccgcccaancttgcttctgtagctccccctcgaggaagtgaggtgtttaattttgcatgttttctggcatgnattaagncccttatnctngtatatatgagtgtncngtttgttctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttca

SEQ ID NO: 432037 - DNA, 915 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggcgacttgtcacagcaggtgaacaggctaccgagcacatgatttatcgaaggtcgagcctcaggtacacacaggagtcggggtcagaggaacagagggggatactctaa

SEQ ID NO: 432038 - DNA, 1015 bp, Homo sapiens
  misc_feature (971)..(971): n is a, c, g, or t
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgtggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggtccactttgtcttctnttgttcttttttttccctcttttcattctctcttttttcctttc

SEQ ID NO: 432039 - DNA, 1264 bp, Homo sapiens
  misc_feature (964)..(964): n is a, c, g, or t
  misc_feature (1264)..(1264): n is a, c, g, or t
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgtggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggccccccccncccccctccccccccccccccccctccctcgtcgcgtttccgctcccctcctccccggcctgcctctccctcctctcgcccctcctctctccgcccttccctgtccgcggtccctctcgccggccgtgtgcgcctcgtctccctcgtcttccgcgtcccgcctcctcgtctctcctggctcctgccccgctctctcgccgtcccttcctgcgcttcgcctctcgctcgctctgttcgttcttcttctcctcctccttcctcctgcctcctccctgctctcctctctgtcccctctgcccn

SEQ ID NO: 432040 - DNA, 775 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccggctgaagatgacttctaga

SEQ ID NO: 432041 - DNA, 817 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagagggggtttgtgggtgaggcctctagcggcacccggggtatcctct

SEQ ID NO: 432042 - DNA, 687 bp, Homo sapiens
gctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaagagatgttggaaggagggatgagatgttggaaggaggaatgagatgttggaaggagccatgagatgttggaaggagcctgagatgttgaaggtaccggccac

SEQ ID NO: 432043 - DNA, 1305 bp, Homo sapiens
ggaaacactaatgtgtgattttaagtagataatacaaaggccctataaaccgtaccatatctgatggagtcggctgtggcatgggcctttctctttgagggagtgagttgtgtgtccttggaaggcatttcccattgcccagtttcattctctttaagagcccctgttgggcaaatgggagggttgcgacaagattgaaatcccttttccatggtcacagccctcagtgtgtaacaggacatctccgcaaccctcaaacaggttaatcccacacaggggcctggctgactttccctcttctctggattccaactagggatagagaagtggaggtatgaccttagcacagaggcattgccactttgggaagaagaaagtgcctcacggccacagcagtgctaagggaagtggcaccctgaccaagcatgcgggtgaagtcatcagctggtgtgcggcgggagggcgcagatctcagatagcagctccctgttgattgctcagcttcattcttgggttctgagaataagccatgggcggaggcacttctgtaagaggaagcagcttcattaaaatcttgggaaattttaatttgcattcaccttctctaaacatgaacatgaatctgtaaagtgatacattctttcttgcttaagaaattaaagcgtttggggatttgagtttttatactctttgaaaattgagtttcttgtgctaaaatcatcattcacaaaatgtcctctcacctgaggaattccaacacagcaaattcaatctgaaataaattgaggctacatttaagagacgggacttccagctaaaaataggtattagagagctgtttttgccaaaaaattgaatacttaaccttattcttcactcttgactcatttgttttgtctcagttctgggtgaactggagggttttctttctttgtattttcatttttgtattcattttcttaatgcgattgaattagatcaacattttatgccttctcttcccgtaacttgcattcacatagacctgatatatgtatgagcctaaatctttgtggttaacacttattattgctttggaataactgtccatatatggaatgattcattcggttggtataaccatttacagggttcttgatacacatttccaaattaacttctaaaaggttttacatgaaaactcttcccatccatagccatcaccagtttcacctcacacacttgctaatgctattaatattattgttagaatttatgctaatctgatgagcgataaaaatgcctcatgttttgtttatttggatt

SEQ ID NO: 432044 - DNA, 913 bp, Homo sapiens
aggaattgggaacaaattgaccctggtttggagccacaactctgctgcttgttctctgtgtgatcccaggcaaatcgttgcgtctttctgagcttttaaaaaatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432045 - DNA, 904 bp, Homo sapiens
acctcgcttccctgggtgccacggtcagcgggacttcggcaagatggctgccctgacagcggagcattttgcagcactccagagcctgctcaagaatgccgtataaatggaataatacagcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaactgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432046 - DNA, 1310 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432047 - DNA, 559 bp, Homo sapiens
aagcaggctggtacggtcggaggtttaggattccaataagtaagtttattggataggctgcatgatttgggcctgaatttctcaaacagctatgcagaggcagctgacgatgcaaatgttccctcaccctgccatggtggtaattaagttgcactcaggagcttttcaaagatgggggcttctgctctccagcttcagaaagagaaagaagatgagtgagaacagcgggggatctggctgccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432048 - DNA, 661 bp, Homo sapiens
tccagatacgtaacgtgtgatcgtatagcgctgcctgatttggagaccagcatcgtctcactgcaggctcctgacaaatcgcatgtctgatcgcagtggcaggatgttgcgcctcacccgtacccataggtgggttaactctaaggttcgctcctcgaccgtaggcgtcttatcacaaagactgagagagcgtctgtctgtctactccaagacattcagcaactgtaggaccagaagcactgagtgagaacagcgggggatctggctgccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaacataccacaacaggttcctaaggacgtgtcaaaccacaccaggaaagccaaaacagacccctatggcatccagaccgagagcacgaacggcgcaagcgcgggcc

SEQ ID NO: 432049 - DNA, 1335 bp, Homo sapiens
acctcgcttccctgggtgccacggtcagcgggacttcggcaagatggctgccctgacagcggagcattttgcagcactccagagcctgctcaagaatgccgtataaatggaataatacagcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432050 - DNA, 1275 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgttctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432051 - DNA, 1255 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432052 - DNA, 1190 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacaaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432053 - DNA, 1206 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatgctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432054 - DNA, 879 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaactgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432055 - DNA, 722 bp, Homo sapiens
cccccgggctgcaggaattggcactgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432056 - DNA, 375 bp, Homo sapiens
  misc_feature (34)..(35): n is a, c, g, or t
tggaagtgtgatgaattgtaattattttgggggnngggggtcggcgcgcatccgggccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432057 - DNA, 1279 bp, Homo sapiens
aggctgtaccggtcggagtcgttggatgcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432058 - DNA, 1184 bp, Homo sapiens
acctcgcttccctgggtgccacggtcagcgggacttcggcaagatggctgccctgacagcggagcattttgcagcactccagagcctgctcaagctgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432059 - DNA, 1228 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaaccccgtcgatccccagcccagcggggagtccgtctagagtcgacatcagcatccac

SEQ ID NO: 432060 - DNA, 1206 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagaatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432061 - DNA, 975 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccattgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432062 - DNA, 971 bp, Homo sapiens
acctcgcttccctgggtgccacggtcagcgggacttcggcaagatggctgccctgacagcggagcattttgcagcactccagagcctgctcaaggcctcctcgaaagatgttgtcagacagctgtgtcaagaaagcttttccagttcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtctacttggagaaccgaagcccaggcaaatcagatctctctgccacgcctggtcgatctggactggagagtggatatcaaaacctcctcagacagcatcagccgcatggccgtccccacctgcctgctccagatgaagatccaagaagatcccagcctatgcggagacaaaccctccatctcagctgtcaccgtggagctgagcaaagaaacactggacaccatgttagatggcctgggccgcatccgagaccaactctctgccgtggccactggagagcagaagcccccatctttgaaaagctcctgagtgcaacttaattaccaccatggcagggtgagggaacaaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaaataaacaacagttctaaaact

SEQ ID NO: 432063 - DNA, 362 bp, Homo sapiens
cctagtccatttaactgatggaggaagcctgagaagtaaggtggtcaaactgagcttgcattctactgagtgatggaattgggatatacattctgagtccagtgctcttttccattgtactctgcagtgtgtatctgttttctctccataactgctacgtaagctttgggaagcagggatgatccttatatgtgccaattagaactgcctggtaaatgcttgttaactaatgtcagccattgtgtcatagttacaagagctcatatgttacaccacctccctttcattatctgttcattttttttgtttgtttgttttttggttttttgtttttgtttttgtttttcttttttaaggcagag

SEQ ID NO: 432064 - DNA, 1608 bp, Homo sapiens
  misc_feature (43)..(43): n is a, c, g, or t
tctgccccaccctgtcctctggaacctctgcgagatttagagnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432065 - DNA, 1671 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaagctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432066 - DNA, 1669 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaagcgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432067 - DNA, 1665 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgacttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432068 - DNA, 1672 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacataaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432069 - DNA, 1675 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432070 - DNA, 1668 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432071 - DNA, 977 bp, Homo sapiens
  misc_feature (43)..(43): n is a, c, g, or t
tctgccccaccctgtcctctggaacctctgcgagatttagagnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432072 - DNA, 1722 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432073 - DNA, 1891 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaagcgtggggaattgagcacataatactccaaataaccatcagatgattctaattccaacatgaccacgtccaggcaactgaactgtcccctggcaagaagtctaggactgaacctgtcccgggcccctgtacttggttcaaaggatttagcctttctcttggccacaccaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432074 - DNA, 1843 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaagaattccaacatgaccacgtccaggcaactgaactgtcccctggcaagaagtctaggactgaacctgtcccgggcccctgtacttggttcaaaggatttagcctttctcttggccacaccaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432075 - DNA, 1637 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432076 - DNA, 1834 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaagcgtggggaattgagcacataatactccaaataaccatcagatgattctaattccaacatgaccacgtccaggcaactgaactgtcccctggcaagaagtctaggactgaacctgtcccgggcccctgtacttggttcaaaggatttagcctttctcttggccacaccaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgacttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432077 - DNA, 1398 bp, Homo sapiens
  misc_feature (157)..(157): n is a, c, g, or t
ggtgcacgcctatagtcccagctactcgggaggctgaggtaggagaatcgtttgaactcaggaggcagaggttgcaatgagccaagatcgcgccactgcactccagcctgggtgacagagcgagaccgtctcaaaaagaaagaagtgactagggttnaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtggagaaggaactcaccccagaggtgctgcaggagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaaatggac

SEQ ID NO: 432078 - DNA, 1436 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432079 - DNA, 1391 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaagcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432080 - DNA, 1356 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432081 - DNA, 1377 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432082 - DNA, 1162 bp, Homo sapiens
aagccgtatcctatcctgagagatcagctacatcaagatgccgcatgaaatttctctggacgattgagctgctacgatctggacccgcctcagttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432083 - DNA, 1554 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgaggtggggttttgccatgttggccaggctggtcttgaactcctgacttcatgtgatcgcctgcctcggcctcccaaagtgctgggattacaggcgtgaaccaccgcacccggcctaagccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432084 - DNA, 986 bp, Homo sapiens
  misc_feature (12)..(12): n is a, c, g, or t
  misc_feature (24)..(25): n is a, c, g, or t
  misc_feature (30)..(30): n is a, c, g, or t
  misc_feature (57)..(57): n is a, c, g, or t
  misc_feature (90)..(90): n is a, c, g, or t
agactgaccagncctcatcatccnnaaaancacggacagcgtctgtgtgcgcatctngagtcttcacacctgttgactcacacggctttngctgatgacacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432085 - DNA, 1275 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactgtgttgcccaggctgctcttgaactcctgatctcaggtgatccgcccgcctcagcctcccaaagtgctgggattacaggcatgagccactgtgcctggcctcaatatttttat

SEQ ID NO: 432086 - DNA, 1454 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactgtgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctgggcaacaagaacgaaactccatctcaaaaaaaaaagaa

SEQ ID NO: 432087 - DNA, 952 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtgatagcaaagatgatgagagggttcctgcttagttgagatagttgaatctagcattcgttcctataaaagagagaggtccattgtgcgccccctttccagtgtagcagtggccttccgggactcct

SEQ ID NO: 432088 - DNA, 1281 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattga

SEQ ID NO: 432089 - DNA, 1082 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatagtgttgcagtgtgctttccgggatcctctagtca

SEQ ID NO: 432090 - DNA, 1367 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcagggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432091 - DNA, 2061 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtatagttaatccttggcttctttattatttatcagtgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactgtgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctgggattacaggcacctgccatcatgcccggctaatttttgtaattttgtggagacggagtttcaccattattggccaggcagtaaaacacacatatttattttaggtctcctcctggacatatttttgttccatagatcagtgtttttatttcattgccagtacctttttaaagctttataatatacttaaatattgggaaggcaagtaatcttgtttccatattttcacatattcaatatctagtttcttgatctacaataattatgctgctgatgataattaacatttactgggcaatttgtgccaagcatttttcttagtgaggaacccatttaatccttctaaggtgggtactgttaacagtttacagatgaggaaaccatggcagagagaggttaaataatattactaccatcacaaagctagtaagtgttagagtaatgatccaaacccaggcaactttgactccggagctaaacttttaactatgctgatcaaaaattaagctaatacctacctcatctgttggtagtagcagttaaatgagatgatatagcattgccctacttactttatgtatagtatctctactctttacaata

SEQ ID NO: 432092 - DNA, 1253 bp, Homo sapiens
taacgctccctaaactgccacttgctcagctccgcgcctaaggtgtctattagtgcgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgattggttttcctcccttgcttagtattgttagcagaatgaatcagggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttt

SEQ ID NO: 432093 - DNA, 2304 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432094 - DNA, 2219 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432095 - DNA, 2082 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432096 - DNA, 2239 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagctcactgcatcctccgcctcctgggttcaagcagttctcctgcctcagcctcccgagtacctggaactacagaatctggtcaacctgtagttccgttggacagacagtttctcatccatgaactaaatgcatttgaagaatcaaaggataatacaatatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432097 - DNA, 2167 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432098 - DNA, 2399 bp, Homo sapiens
gaagtgccttaagtagactcttcatttacttttctggtaatggtttaaatatcatttgttatgcatttttaagatacagttcagaatgacacattgatatggtcaaaaagcaaacagccagacatttgcgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432099 - DNA, 2376 bp, Homo sapiens
cgcgtgcgcaggccgcggtgcggccctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagctcactgcatcctccgcctcctgggttcaagcagttctcctgcctcagcctcccgagtacctggaactacagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggt

SEQ ID NO: 432100 - DNA, 2470 bp, Homo sapiens
gaagtgccttaagtagactcttcatttacttttctggtaatggtttaaatatcatttgttatgcatttttaagatacagttcagaatgacacattgatatggtcaaaaagcaaacagccagacatttgcgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagaatctggtcaacctgtagttccgttggacagacagtttctcatccatgaactaaatgcatttgaagaatcaaaggataatacaatacctcttttatatgggattttagcccatttcttgcgtggaactaaggatggcatccagaatgcatttctgaaagggccttcacttcagccttcagacccaagtcttggcagacaacctagtagaagaaagccaatggatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcgcacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtttgcatggcttctggggcaaaaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaactttcctagaattatttttcactctaagtcatgtatgtttctcttcgactatttgcatgttatg

SEQ ID NO: 432101 - DNA, 367 bp, Homo sapiens
gagacgagggcgggcgctcagggacggttcgaacagtctgggcctagtcaatgtaaagacaatgaggatgaagacctttatgaagatgacttccacttaatgaatacagcattctacatccaggtaccagctttatgatagtgagagaagaggaacaagacaccatgtcttgccaatgcccgtctagcatgcgtggagtgcatatacagctacaagtcctagtggcagcccactcctgattcctggctcacacagtggtgccctcctgaagccaacagttcctgtggaagctgcctgacactctacagtgactttcctgattgtgatagaggtggcagccattaaaaaaaaaaagaaaaaagaatgg

SEQ ID NO: 432102 - DNA, 2205 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432103 - DNA, 2123 bp, Homo sapiens
agacacccacctttctagccctacctcccacttagtgattgtctgtaaatacgcacggccttaccttggcactgagagagatgcatggctgagtaggtgtcatctcatctgtaagaagcaatagcagaggggatgcagaaggagctgctctgttctgctcattgtcacctgctcctctgcacaccttccttcatgctcttccctcagcctctccccagctcacacccctttatttgaaactctgctcatttttcaggccctgcttcaatgccaccacctccgtgcagcctcctctgatgtttgtcattagcttagctcttccgtgtgtgctcctgcaccactgatcccttccacaacatggactgtctgtgatgcacgtgtgcaggatgctgggaatgcccaggtggaaagacacacgtgctgcccccaggaactgactgactggtgtttgatatacagaggaaagtcacctataggaacctgagcacctggtatacagagcttcgggagttcaggccagagatcccatgcatcgtggtggccaataaaattgatgagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432104 - DNA, 575 bp, Homo sapiens
  misc_feature (130)..(131): n is a, c, g, or t
  misc_feature (133)..(133): n is a, c, g, or t
  misc_feature (135)..(136): n is a, c, g, or t
cgcagggttctcttcttcttgtttctgggacatggcgggaccgggactgtggagtgtaaggggcccgggaaggcaaccggagaagggaagggggaggggaaacggggacaaccctgcgctgctgcttcgnngncnntccccgaattcggcacgagccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432105 - DNA, 873 bp, Homo sapiens
agacacccacctttctagccctacctcccacttagtgattgtctgtaaatacgcacggccttaccttggcactgagagagatgcatggctgagtaggtgtcatctcatctgtaagaagcaatagcagaggggatgcagaaggagctgctctgttctgctcattgtcacctgctcctctgcacaccttccttcatgctcttccctcagcctctccccagctcacacccctttatttgaaactctgctcatttttcaggccctgcttcaatgccaccacctccgtgcagcctcctctgatgtttgtcattagcttagctcttccgtgtgtgctcctgcaccactgatcccttccacaacatggactgtctgtgatgcacgtgtgcaggatgctgggaatgcccaggtggaaagacacacgtgctgcccccaggaactgactgactggtaggcacagtacagataccagtggtgaggacagtgaggattcttcccttctgaccctttgcagatggtaaaggaaggaactcgtcacctaattcccccgactgcccgttaagaacaaaatcccttgaaaaattccaaaagctttaactctgataactgttaaggtactaaacaagaggataatggggcaaggaaaatgggggcagtgtagtgcagaagtctgaccctcaagagcagaggagcttggtcctagccagtttggtttcaggcctacagtggcatttggtattttgagctcacctctctttttctcttggagtgactgcttcctgcatctgctgcatctccgtgggctcccctcagaccctcttctgaaggcctggggtgtctctcctgccaccatgcctgtgtctgcaggtgcctgccacc

SEQ ID NO: 432106 - DNA, 3832 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcatacccacttagatggcgaggacaccgacaagcaagtcttcgcccgtaagcggtggctcacgcctatagtccagggatgccgaggagggaggatcgcttgagtccaggagttggaggctgcagtgagccgtgatcgcgccactgcactccagcctgggcgacagagtgagaccctatctctaaacaaaagaaagaacgtcttcaagcatggagccatgaagctggatttggctttctgtcgctctctctacagggtacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432107 - DNA, 4102 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcatacccacttagatggcgaggacaccgacaagcaagtcttcgcccgtaagcggtggctcacgcctatagtccagggatgccgaggagggaggatcgcttgagtccaggagttggaggctgcagtgagccgtgatcgcgccactgcactccagcctgggcgacagagtgagaccctatctctaaacaaaagaaagaacgtcttcaagcatggagccatgaagctggatttggctttctgtcgctctctctacagggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccatgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432108 - DNA, 3253 bp, Homo sapiens
tggagatttggttgaggggacttatctctgacaacagcctcttgttgatcttcccagactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432109 - DNA, 2634 bp, Homo sapiens
gactgcatcaattggcaaattgattccatttatgattgttaaaataggtgaataagattagatgacaagataacaaaaaaggaatacgttatttatttgtttatttcagacagagttttgctcttgttgcccaggctggagtgcaatggcatgatctgggctcactgcaacctctgtctccctagttcaagcaattctcctgcctcagcctcccaagtagctgagattaccggcatgcgccaccacgcccagctaattttttgcatttttagtagagacggaatttcaccatgttggccaggctggtctcgaactcctgacctcaggtgattgacccgcctcaacctcccaaagtgctgggattacaggtgtgagccactgcactgggccaagaataagatttttaaaaacattttcgcatctggaggctccagggggcttccctgagaaacggcagcctctgcggtcagagaggctgcaattcagagcgttcccacaaacagcaccatgtgctcatgcttacctgcttgggtgtgtgagtcacctggagatggggtgcagaaacattgacatacctgagctatctttcttcctctgccctttgcaggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432110 - DNA, 3292 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432111 - DNA, 1375 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtacgagacggtggggaggtggacaaaggcac

SEQ ID NO: 432112 - DNA, 1890 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcatacccacttagatggcgaggacaccgacaagcaagtcttcgcccgtaagcggtggctcacgcctatagtccagggatgccgaggagggaggatcgcttgagtccaggagttggaggctgcagtgagccgtgatcgcgccactgcactccagcctgggcgacagagtgagaccctatctctaaacaaaagaaagaacgtcttcaagcatggagccatgaagctggatttggctttctgtcgctctctctacagggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccatgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggcttgtatccttcaaggtttgaagtactccttgttcctgtgggtcttcccacgctcatgtatcagtgtcccactgcccacccctttgtaccagcagcccaggaacaggaaggaggattgggtaagtgaacgcacaggttttgttctgcacttgtttcttgccgattgacccacatggcattgcacaatcagtgctgtatattttggaccttactcatatttggattgttttatattaagagggcagtagaatggcaaacagcaaatggtttggatctaatgcctggattcaaaccccacctcctcctcctcagtagcttctgatactggccaagtcatttaacctctctaacctcaaagcttgggccccctactattgaaaaaaatctctgatatgaatgaactttgtttggagtgagttcctccccgcaactgggagatttttaaacagcttcccaagtggatccactgagaaccacaggtgagaggagcccctggagcctgctgctgcctgtcctaggctcggcaccccaaggctcagttgccttaagatctgagtatgtgttactccaccttgtaccaagtgctcctgcacacccagcccacctgcgtcatttggctctgctttttacactgtccagcttcttgcagcctcggaaggtgttaatccccagagtttaaccctttttctcagggtttcacacatagacagactccaaattgattgacagcttgtcaactgtatggcttgtgggagcttctgtccctggaatggtcatgttgctacctagggttag

SEQ ID NO: 432113 - DNA, 637 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432114 - DNA, 1155 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432115 - DNA, 3370 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtgggtaagtggcacagggccaagacatgctgaccctcaggaaagaggaaatgggagacgaggggaggtgaggcaaggttcataaggagagagtccagagggagaaaatgagaccccaggcagggacaaggggtgctagagagaacccagagagccaggagccaggagggtggaagggggcatgcaggggcaagtcccagccctctgacctggcgtccaggccagcacctgtgcaggacagggttcaggaaaggagaagtcagggggctgtacccacctcagggaagaagaacataagaggccttcgacgaggcagtagttttcctagcttcaggggttcttactcagccagtttgaaaaaataaatgtggtcagaacattatctcccacatcgggctgcgaccttccatcgggtcataatcttctccttggccgggcacacagcctgcctgactctgtctaccgtctgtggtcatcgcacgtgagaagttggaatagtttggaacttagaggaccctgcgtgtcacgtgggaaacggggaactgtcttctccctccttgggcttccagtgtgttgtccttcctcctggcccctgacccactgtcttcccatacacacaggtgaagacacacctctcacatcacactcaggtgcactgtgtcttgaagacacacgtgtggggctgtatagtctctgtttctccctgtgctccccatgtacactcacacatgtgctgtggtttgtgccgcatgtgtgttgtatcttagtgacttgcacagaaatgcaccaggcatgtaggtctgtctgtgttcacattgcagacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432116 - DNA, 2013 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgattacccccccacccacagctgagtctgtgaggccccatcctttccctacgttttctcccatcttttttcctcttcagtctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacattgagtaaatgtatgt

SEQ ID NO: 432117 - DNA, 975 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcatacccacttagatggcgaggacaccgacaagcaagtcttcgcccgtaagcggtggctcacgcctatagtccagggatgccgaggagggaggatcgcttgagtccaggagttggaggctgcagtgagccgtgatcgcgccactgcactccagcctgggcgacagagtgagaccctatctctaaacaaaagaaagaacgtcttcaagcatggagccatgaagctggatttggctttctgtcgctctctctacagggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccagtaaggctcacctattgctgctatctcatcatcatatcatttctatgtgcccccctagctaagagtc

SEQ ID NO: 432118 - DNA, 1537 bp, Homo sapiens
tgcgcggttgcgtagcagctgcgaggacgcggggcgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacgtgagggcaaatccgccccggtggctggcttagcacgcggggacagcccctccgaggcctccctagcggtgtgggcgagagggcgtccgggtcgggggaagcacggaaaggtggcttcgcgaggctgttgtggggggcgggacgggcagcctggcgatgcctggacatggttggtggccaaaaacatttatcgaaagatagcatacccacttagatggcgaggacaccgacaagcaagtcttcgcccgtaagcggtggctcacgcctatagtccagggatgccgaggagggaggatcgcttgagtccaggagttggaggctgcagtgagccgtgatcgcgccactgcactccagcctgggcgacagagtgagaccctatctctaaacaaaagaaagaacgtcttcaagcatggagccatgaagctggatttggctttctgtcgctctctctacagggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccatgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggcttgtatccttcaaggtttgaagtactccttgttcctgtgggtcttcccacgctcatgtatcagtgtcccactgcccacccctttgtaccagcagcccaggaacaggaaggaggattgggtaagtgaacgcacaggttttgttctgcacttgtttcttgccgattgacccacatggcattgcacaatcagtgctgtatattttggaccttactcatatttggattgttttatattaagagggcagtagaatggcaaacagcaaatggtttggatctaatgcctggattcaaaccccacctcctcctcctcagtagcttctgatactggccaagtcatttaacctctctaacctcaaagcttgggccccctactattgaaaaaaatctctgatatgaatgaactttgtaaaataggagctgccagccccacctttctcccatg

SEQ ID NO: 432119 - DNA, 1050 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432120 - DNA, 1485 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgagcggaagaatccatctttccacggacaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432121 - DNA, 1107 bp, Homo sapiens
ctcccggggctcttccttggggctctgtggcccagggcgacagtgacgggcccctctccccaggcagctccagcaccaactctgtagcagaacctgcccaggtcttgcaggtttgaggtagaggctgggatgttctgggcttgggggaggggaagggcagattggctgggagatgacccaggtgggtctctatagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432122 - DNA, 1121 bp, Homo sapiens
tgtcaatagacatacacagtctaggcattgtgtaaactggctgtgttcccagcagagatactgcaccctcctgaccgagcagtcaggcttccctttcctagccatcctaggttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctactgttttttttttgcatccatacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432123 - DNA, 1341 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaagtgagccctaagcagcccctgcttctcatgttcccaggaggtggggaactggggggctggaaccagggaggacatcaagaaggggtcagggaaacaccatgatcacgaaggtcgttcttccagggcaaaccttgtatctattgccctccagagttgctgacccctgcgacttccccaaacgtgggaaagaaacgcaattgcataatttgtggtggcagcaaatgtgtttgagctttcccctgggggagaaaaaagaaaggggaaccctcatggtgcccacatgcctgtcagggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432124 - DNA, 897 bp, Homo sapiens
  misc_feature (875)..(875): n is a, c, g, or t
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctccggtggcagtcnagcagggaggggaccaggatgt

SEQ ID NO: 432125 - DNA, 950 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgagcggaagaatccatctttccacggacaggagtgagcactgcacgcaggatccgcccagtgcttgggccaagcaccctgtggcatccaagctcccctggacgttacccttggtgaaccaaggtggcatggcagcgagcacagacatggctgggtgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432126 - DNA, 1054 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgagcggaagaatccatctttccacggacaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgtcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432127 - DNA, 518 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaatcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432128 - DNA, 901 bp, Homo sapiens
  misc_feature (6)..(6): n is a, c, g, or t
  misc_feature (12)..(12): n is a, c, g, or t
  misc_feature (62)..(62): n is a, c, g, or t
attcgngcacgngggcaaggaggaggccttcgatgccatctgccagctggtggaggcaaagngccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagactcataagacctttgtcaaaaaaaagaacccacggtgaacggaaaggcgactaaggggccggacaattggcctaaggaacaacgggacaggaacttcgtggagtctctcaaaaaag

SEQ ID NO: 432129 - DNA, 1141 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432130 - DNA, 1181 bp, Homo sapiens
  misc_feature (6)..(6): n is a, c, g, or t
  misc_feature (12)..(12): n is a, c, g, or t
  misc_feature (62)..(62): n is a, c, g, or t
attcgngcacgngggcaaggaggaggccttcgatgccatctgccagctggtggaggcaaagngccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432131 - DNA, 1398 bp, Homo sapiens
ctcccggggctcttccttggggctctgtggcccagggcgacagtgacgggcccctctccccaggcagctccagcaccaactctgtagcagaacctgcccaggtcttgcaggtttgaggtagaggctgggatgttctgggcttgggggaggggaagggcagattggctgggagatgacccaggtgggtctctatagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaagtgagccctaagcagcccctgcttctcatgttcccaggaggtggggaactggggggctggaaccagggaggacatcaagaaggggtcagggaaacaccatgatcacgaaggtcgttcttccagggcaaaccttgtatctattgccctccagagttgctgacccctgcgacttccccaaacgtgggaaagaaacgcaattgcataatttgtggtggcagcaaatgtgtttgagctttcccctgggggagaaaaaagaaaggggaaccctcatggtgcccacatgcctgtcagggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432132 - DNA, 918 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432133 - DNA, 1227 bp, Homo sapiens
ggcggagccgcctgagcggagtcccacccgggagccggcagggagcggagctgcggagccgcctggtctcccgcgtccatcggtccattcctgcgtcgttctgtccttccgaacgcacacttcaggagcagccgcgaggtagaagcccataggagacccagatgcccgccaccccaatcagtatcctgcacgatgagggttggggggagcagcctggaaagggtcccaacctccggcggtcccagccgaggagccagctgagcggccctgccctggccccaagcattccacctcgcagcccccacctcctggtccggctgattgatgactccagctgtcccagtgggagcgggacgggtggctccagttcacgggtgtggccactccatccatggcctgcagacccatggggctgcggcctgcaacccagcgccacctgaccgcgctgagatgagcggaagaatccatctttccacggacaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 432134 - DNA, 2068 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432135 - DNA, 492 bp, Homo sapiens
caggcccagcaagtgcaaaggcccggaggtgggaagcgatgcagatatggctggaggggagggcggacttcaagggccttggaggttgggagccactttcaggctgagcctcccggcttctctccccagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432136 - DNA, 538 bp, Homo sapiens
aacctgggacgtagaggttgcagtgagccgagatcaagccactgcactccaacgtgggcgagagaccgagactctgcttcaaagacaaaacaacaattttttaaaaattttaattcaaatgaagtacaattgcaaatttagcctctgacttgcaccatcctgtatccagtgctcaaaagccagtgtggctggtggctgccatattggacagcatagatattgaatacttccatcgcctctagactgaagagatgggagcccaggggcagtgcaccgaggggaaggaatagctaaagcaaaggtctagtagcctgaaaaaacttggagaaaagatggcccctccatgaggccgagtgagaggaaggaagccttggctgggaccctgccacatccaatgtcaccggcagatgggtacacccccttttccccatgcatggattcagctgtcccacagacacattgactcaggcccttggaactacttcctgtcttgccttagcacgtagacatcacacacatgcatccactcaggtgggca

SEQ ID NO: 432137 - DNA, 2524 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggtgagcccctgagccccagaccagcactgaccaggggccctggcctgtcctgggattccccaagccccagatcagcgctgcctgggggccgtgacctccccaggaatccgctgagcctcagatcagcacagaccagggaccccgtcctgtgctgagatcccccaagccccagaccagcactgaccggggttcttgactcaccccaagcaagccctgagcccactgaccaaccaaaaccagccgtgcagccccctaggtctccagcctggcctggcaccaatgctagcctcccaaggctccatgccatccttggccctacccgctctgccctccccgcaggagacaacagcttccggctcctgtttgacgtggtggtcatcctcacctgctccctgtccttcctcctctgcgcccgctcactccttcgaggcttcctgctgcagaacgtgaggcttctgcgtcatgtgtgctggtgtcctccccgcctggccctggggcgataaaagccagggctttgagggtcctgtgcctggtcaggccctcaccccgcctgccttctgcaggagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432138 - DNA, 2896 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggctgggcacggtggctcacgcctataataccagcactttgggaggctgaggaggaaggattgcttgaggccagaagtttgagaccagcctgggccacgtaggaagaccttgtctctacgcacaaacaaattagctgggcgtggtggcgtgcccctgtggtcccagctactcaggaggctgaggcaggaggatcgcttgagtccgggaggttgaggctgcagtaagctatgaccacgctgctgcactccaccctgggtgacagagtgagaccctgtctcaaaaaaaaaaaaaaaaaaaaaaaacaagtatgcttagtgtgagtgtgactcttgccacgtagaaagcaccagatgttatattttaatatggctcattcagtaaaacatccgcaggcccagagagtgccaggcctgtaggaatgacccaaccctggggaagcacagggaagaaggccactggggactctggggagaccagcctggcctccccggccccctgaggcccttccctgactccctgtccttagactgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432139 - DNA, 2333 bp, Homo sapiens
acagagtgagactctgtctcaaaaaagaaaagaaaagggacccagtcatggtacttaccctgaaagtttgggtttaacacagaatcggacatccagtaaacatttaatgaacgttagtccctgcagtgagatagatgagtccccaccctgtgttgtacgggggaggacacagtggtgggcgtggcatggagcttatgccaggaggtggggtgaaattaatcaaagcaaagaaatgcacaagtgaaatccgtgtttgtggcccaagttagcagggccctgccccaccccagtggacatctgcagggccctccctgtcctcttccagggcctgtgccctgagggagatacaccccaacccccatcctagccatgccaacctctactaccctctccccagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432140 - DNA, 2099 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaaacaaaaaaaacacacaaaaaaaaacaaaaag

SEQ ID NO: 432141 - DNA, 862 bp, Homo sapiens
gaggatccctggatgtgcgtgcatgtgggcacatcatgaagatggcactgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432142 - DNA, 1048 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggctgggcacggtggctcacgcctataataccagcactttgggattacttgcacgtgccaccacacctggctaatttttgtatttttactagagatggggtttcaccacgttggccaggctggtctcgaactcctgacctcaggtgatccacctgccttggcctcccaaggtgctgggatttcaggcatgagccactgaacccagctaagtcatacagtttcaatgaccttgtcattgaccctgggacgttgccattaacatggtgatcctcagctggccc

SEQ ID NO: 432143 - DNA, 740 bp, Homo sapiens
aacctgggacgtagaggttgcagtgagccgagatcaagccactgcactccaacgtgggcgagagaccgagactctgcttcaaagacaaaacaacaattttttaaaaattttaattcaaatgaagtacaattgcaaatttagcctctgacttgcaccatcctgtatccagtgctcaaaagccagtgtggctggtggctgccatattggacagcatagatattgaatacttccatcgcctctagactgaagagatgggagcccaggggcagtgcaccgaggggaaggaatagctaaagcaaaggtctagtagcctgaaaaaacttggagaaaagatggcccctccatgaggccgagtgagaggaaggaagccttggtcgagtcccgggtctggcacattcagattggaggttacggaatggggaaaggggagcgagccagagaaaactgacgcccctcttccctgcttccttcctccagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaaacaaaaaaaacacacaaaaaaaaacaaaaag

SEQ ID NO: 432144 - DNA, 2303 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432145 - DNA, 907 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcaggtgaggccagccaagcaggggccccagctgaaggccacctgtggctgctgtgctccttgaagagagtcttaaagcagcactttggaaggccgaggccggtggatcgcttgaggctgggagttcaagaccagtctggccagcatggtgaaaccccatctctactaaaaatacaaaaaaattagccgtgcgtggtggcgggtgcctgtaatcccagctacttggcaggctgaggcaggagaatcgcttgaattgggaggcggaggttgccgtgagctgaaatcatgccactgcactccagcctgggcaacagagcaagactgtctcaaaaaaaaaaagaagccgactctgaggctcagagaggttaggagacttgcccaaagtcacacagcaatagaacattgggagctgggatttgaacccaggcagtctgacaccatgttgacccaatggctgcacagatagttctccctcccccatgccagaccctgtgctgggctctgggaaccccaagatgaatcagacccagccactgccctaagt

SEQ ID NO: 432146 - DNA, 1919 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432147 - DNA, 2113 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcaccctcttggaaagcagctccagttacaagaacctcacgctcaaattccacaagctggtcaatgtcaccatccacttccggctgaagaccattaacctccagagcctcatcaataatgagatcccggactgctataccttcagcgtcctgatcacgtttgacaacaaagcacacagtgggcggatccccatcagcctggagacccaggcccacatccaggagtgtaagcaccccagtgtcttccagcacggagacaacagcttccggctcctgtttgacgtggtggtcatcctcacctgctccctgtccttcctcctctgcgcccgctcactccttcgaggcttcctgctgcagaacgagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaagaacttggcgagctacgacgtctgcagcatcctcctgggcacctcgacgctgctggtgtgggtgggcgtgatccgctacctgaccttcttccacaactacaatatcctcatcgccacactgcgggtggccctgcccagcgtcatgcgcttctgctgctgcgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcatttttagcgggaggagcagtccttgcgttaag

SEQ ID NO: 432148 - DNA, 1190 bp, Homo sapiens
ggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactgactgcatccaggtggatccccccgagcggccccctccgccccccagcgacgatctcacccctcttcatctacatggtgctcagcctcttcatcgcgctcatcaccggcgcctacgacaccatcaagcatcccggcggcgcaggcgcagaggagagcgagctgcaggcctacatcgcacagtgccaggacagccccacctccggcaagttccgccgcgggagcggctcggcctgcagccttctctgctgctgcggaagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaa

SEQ ID NO: 432149 - DNA, 783 bp, Homo sapiens
ttttcctcctttttggcttacatagcgttccagagactgaacttctcaaatcactgcttcaacagcttttaaaaatctggacctagttactcctgtcatctatgtgtaaagatttagaaaaaaaatcccaaacccaagggtgggcagccgcgaggatgtacagctcctggcagtgtgcgctcacccggagacctgaggtcaaagcccaaatgctgagcacctcctgggaggcgggagcatggtctgctcagtgccagacatctggatattgagaaaacatctgggtagctggggttttcaggtttctgcctgacatttaatatcacaaacattgagcctgctcctgtcccccaccagccacgcggcttctcctcccaaacatacccagctccttcccctgccttcctgacgggtaagaaacatccattctttccaattccccagccgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccataacaaagtcttgccctgtattaaatgcaattttcttaaaaacaagcaaaccttttggacatcattttattttaatagaaatgctgagttttatgaaactaaagtggctaataaatcagacctgaagctttgtgtgagtgttcc

SEQ ID NO: 432150 - DNA, 834 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccaggtaagcagccccggcggtttcgccgcatacgggactgcggggcgaccgcgggcaccagccacgcgcagcggctccgcggggtctcggccgggtccgcgctctgaaggatctcgagagccatggatggtgcaggcgggaccctcgagctgcagcatctccggtgacccggggttgccgaggaggtggagaccagcacaggtggtccggcccgggcgcctccgaatccgggggtggtcaagacggatccccaaggctgaggtcggcagtcccggggactcgcagctgttgagcctgtggagacgcggccccgtgaccgaggcacccttcagcaacccgggggcagcgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccataacaaagtcttgccctgtattaaatgcaattttcttaaaaacaagcaaaccttttggacatcattttattttaatagaaatgctgagttttatgaaactaaagtggctaataaatcagacctgaagctttgtgtgagtgttcc

SEQ ID NO: 432151 - DNA, 1254 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccaggtaagcagccccggcggtttcgccgcatacgggactgcggggcgaccgcgggcaccagccacgcgcagcggctccgcggggtctcggccgggtccgcgctctgaaggatctcgagagccatggatggtgcaggcgggaccctcgagctgcagcatctccggtgacccggggttgccgaggaggtggagaccagcacaggtggtccggcccgggcgcctccgaatccgggggtggtcaagacggatccccaaggctgaggtcggcagtcccggggactcgcagctgttgagcctgtggagacgcggccccgtgaccgaggcacccttcagcaacccgggggcagcgttccagagactgaacttctcaaatcactgcttcaacagcttttaaaaatctggacctagttactcctgtcatctatgtgtaaagatttagaaaaaaaatcccaaacccaagggtgggcagccgcgaggatgtacagctcctggcagtgtgcgctcacccggagacctgaggtcaaagcccaaatgctgagcacctcctgggaggcgggagcatggtctgctcagtgccagacatctggatattgagaaaacatctgggtagctggggttttcaggtttctgcctgacatttaatatcacaaacattgagcctgctcctgtcccccaccagccacgcggcttctcctcccaaacatacccagctccttcccctgccttcctgacgggtaagaaacatccattctttccaattccccagccgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccataacaaagtcttgccctgtattaaatgcaattttcttaaaaacaagcaaaccttttggacatcattttattttaatagaaatgctgagttttatgaaactaaagtggctaataaatcagacctgaagctttgtgtgagtgttcc

SEQ ID NO: 432152 - DNA, 1111 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccaggtaagcagccccggcggtttcgccgcatacgggactgcggggcgaccgcgggcaccagccacgcgcagcggctccgcggggtctcggccgggtccgcgctctgaaggatctcgagagccatggatggtgcaggcgggaccctcgagctgcagcatctccggtgacccggggttgccgaggaggtggagaccagcacaggtggtccggcccgggcgcctccgaatccgggggtggtcaagacggatccccaaggctgaggtcggcagtcccggggactcgcagctgttgagcctgtggagacgcggccccgtgaccgaggcacccttcagcaacccgggggcagcgttccagagactgaacttctcaaatcactgcttcaacagcttttaaaaatctggacctagttactcctgtcatctatgtgtaaagatttagaaaaaaaatcccaaacccaagggtgggcagccgcgaggatgtacagctcctggcagtgtgcgctcacccggagacctgaggtcaaagcccaaatgctgagcacctcctgggaggcgggagcatggtctgctcagtgccagacatctggatattgagaaaacatctgggtagctggggttttcaggtttctgcctgacatttaatatcacaaacattgagcctgctcctgtcccccaccagccacgcggcttctcctcccaaacatacccagctccttcccctgccttcctgacgggtaagaaacatccattctttccaattccccagccgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccat

SEQ ID NO: 432153 - DNA, 691 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccaggtaagcagccccggcggtttcgccgcatacgggactgcggggcgaccgcgggcaccagccacgcgcagcggctccgcggggtctcggccgggtccgcgctctgaaggatctcgagagccatggatggtgcaggcgggaccctcgagctgcagcatctccggtgacccggggttgccgaggaggtggagaccagcacaggtggtccggcccgggcgcctccgaatccgggggtggtcaagacggatccccaaggctgaggtcggcagtcccggggactcgcagctgttgagcctgtggagacgcggccccgtgaccgaggcacccttcagcaacccgggggcagcgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccat

SEQ ID NO: 432154 - DNA, 641 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccaggtaagcagccccggcggtttcgccgcatacgggactgcggggcgaccgcgggcaccagccacgcgcagcggctccgcggggtctcggccgggtccgcgctctgaaggatctcgagagccatggatggtgcaggcgggaccctcgagctgcagcatctccggtgacccggggttgccgaggaggtggagaccagcacaggtggtccggcccgggcgcctccgaatccgggggtggtcaagacggatccccaaggctgaggtcggcagtcccggggactcgcagctgttgagcctcgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccat

SEQ ID NO: 432155 - DNA, 491 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccagcgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccataacaaagtcttgccctgtattaaatgcaattttcttaaaaacaagcaaaccttttggacatcattttattttaatagaaatgctgagttttatgaaactaaagtggctaataaatcagacctgaagctttgtgtgagtgttcc

SEQ ID NO: 432156 - DNA, 348 bp, Homo sapiens
tcctgagggccagagaaagggagaagggggtggggggacagccacgtggccgcaggaggatttacaacattttctttcgccatcgatgttatcgcaaaatgtgtgagagaagcggctgcgcagcccggacgggagcgtgagggtgcgggccagcgttttccccctaccggaaatctgatgggcttatgacatcatggctggctgctgagcgatgaagtggatgccacaaagaaatccgacatatcagatagattctgaaatcggtttccctccagctgtagtaacaggcgtgaagtcaggagaatttgagctttgtttaaaaaataaataaataaataaataaaccat

SEQ ID NO: 432157 - DNA, 2068 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 432158 - DNA, 921 bp, Homo sapiens
caagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtat

SEQ ID NO: 432159 - DNA, 977 bp, Homo sapiens
gcggttcggtcctcgcacccggcagccgccactggtgctgagctgctaggaagcccctatcgccgagctcgttggagcttggcgaagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaaaaatctcgaaatatagtttttttctttctggggcccggaaccctcgtgttggaggggtggcgagtcaccttaaagccgggagcggcgggtaagaggcggggccgggcaccccccttttggacctcccagtgccgccgggccatcaaagatcaagactatgggcccagaaacttgaaggactagggcggggacaggctcgcccgccggggccccggggctatgggcacggccctgaagctggttggctgggagggccgggcgccagagggcctaacgagggtggcgcgaatctggtgtacaccgggggaatggcggggcacaagagccatcttcttcaacacggatcgggtgggagtgcagcaggaccactatcctgggccggagggccttcacttcaggaacccttggttccagtaaccccaattatctattgacatcgcgggccagaacctcgaaagattcccttcccctagtgggtccaaagacctaccggatggtggatatctccctgggagtgtgtgttctgcacccacatggtcagagagctccctaacagtggcacaggggctaaggcgtgggaaaggggacgatggtgcgcggccatgggccagggggcccagtggtgggggcagtcagcgctaggtgacaccacgggccggtaccggagacgcgggctcaaaaggcgggtaccatcgggtgggcacaaatgttccggtcagttgtaaccatggcgcggcattgaacagacgatgcgc

SEQ ID NO: 432160 - DNA, 927 bp, Homo sapiens
  misc_feature (541)..(541): n is a, c, g, or t
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaaaaaaaaaaaaaaaaattttgtggggcgcggcttgggccttggaaaagttttttaaaaccttttgtttgggggggggggcgccccttggttatttgtggaccctgtgggccaaggggttccaagggaaacccggggtcaagaaactaaggtggtcggtggttctctccaccaattataaaaaaacgcgccgggggggaacaccggcggcttttctgggaacaatcccagaagttgggtgttccgagaggggcactcaccggggatctatcacacgggaggctccaacgggacgccccggattatcaaaattctccgcgcgcgcgtggganaacgaagagagcacaaagaaaagacgaaagaaaaaacgaagacaagagccaaagcgaaagagagagaaagaaaagcagaagagaggaaaaaacacgaaaagaacagaggaaccaaaaaaaaagaaaggaagaaaacagaaaaaaaagaacaaaaaacaaagaaaaccaacagaaaccccaaagaacgacaagcaaagaacaaaaaaaagacaggagagaaagaacagaaaaggaacacgaaccagcaacacaaaaaacagcagaagaaagaacacaaaaaaaaaagaacgaaaaagaagaaagagcagagccaaaaaaaggaaaaagacaagaaccaaaaacgaagacaaaagagaagtacagaagaagaaagaaaccgaaaaaaa

SEQ ID NO: 432161 - DNA, 4487 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432162 - DNA, 3587 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432163 - DNA, 4571 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcaaaaacaagaagcgaaacaaaacgaggcgcgacaaaaatacccaggggccacaataaacgtacaccgttatgaaacaggggccat

SEQ ID NO: 432164 - DNA, 4518 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcaacaaaacaaaaaaaacacaacaacaaaacaa

SEQ ID NO: 432165 - DNA, 4346 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtgtgtggagcttcggcgtgtgcaggggatcctct

SEQ ID NO: 432166 - DNA, 3631 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatgggactcgtcagaggtggaactcgtcagaggtggactcgtcagagtgtggatcctctagagc

SEQ ID NO: 432167 - DNA, 3532 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagatggagtttcgctcttgttgcccaggctggagtgcaatggcgtgatctcggctcactgcaatctctgcctcccgggttcaagtgattctcctacctcagcctcccgtagctgggattacaggtgcacgccaccacgcccagctaattttgtatttttagtatagccagtgtttctccgtgttgatcaggctggtctcgaactcgtgacctcatgtgatctgcccacctcggcctcccaaagtgcagggattacaggcatgagccaccgcgc

SEQ ID NO: 432168 - DNA, 2516 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctcccaagccccagatcgccattggtaaacaacagctctattaataaagcctttaagtgtcacacatgctttaaa

SEQ ID NO: 432169 - DNA, 2381 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggttggtgattttgctcattatggtcgtggagtgctgattgattcacagtagataaagctggcagtaagaaatgctaaggtaagtgttgaaagcaatgg

SEQ ID NO: 432170 - DNA, 3553 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432171 - DNA, 4510 bp, Homo sapiens
  misc_feature (1771)..(1771): n is a, c, g, or t
  misc_feature (1774)..(1774): n is a, c, g, or t
  misc_feature (1778)..(1778): n is a, c, g, or t
  misc_feature (1806)..(1808): n is a, c, g, or t
  misc_feature (1810)..(1810): n is a, c, g, or t
  misc_feature (1812)..(1812): n is a, c, g, or t
  misc_feature (1814)..(1814): n is a, c, g, or t
  misc_feature (1817)..(1818): n is a, c, g, or t
  misc_feature (1840)..(1840): n is a, c, g, or t
  misc_feature (1849)..(1849): n is a, c, g, or t
  misc_feature (1851)..(1851): n is a, c, g, or t
  misc_feature (1858)..(1858): n is a, c, g, or t
  misc_feature (1860)..(1860): n is a, c, g, or t
  misc_feature (1863)..(1863): n is a, c, g, or t
  misc_feature (1867)..(1867): n is a, c, g, or t
  misc_feature (1871)..(1871): n is a, c, g, or t
  misc_feature (1874)..(1875): n is a, c, g, or t
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatanagnctgngcctcactctcagcagcgcgctcgcgcnnngngngnatnnccaccccatcacacgcaccccnaggcggggncngccgacngnaancccnaaantcnncccagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432172 - DNA, 2049 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttattctgccgggtgatcctctagga

SEQ ID NO: 432173 - DNA, 5120 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432174 - DNA, 2039 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctccccttcccatctttcctaatggtgagccttcgtgccccccttcccatctttcct

SEQ ID NO: 432175 - DNA, 2026 bp, Homo sapiens
  misc_feature (18)..(18): n is a, c, g, or t
ggcagtacccccggttantgtagcgaggctgggagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 432176 - DNA, 4276 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432177 - DNA, 1831 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcggaaagtgggtccgagcag

SEQ ID NO: 432178 - DNA, 2576 bp, Homo sapiens
caagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 432179 - DNA, 2380 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432180 - DNA, 4282 bp, Homo sapiens
aaagctaaggtagaggctggtgtgaatcggccgaggttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432181 - DNA, 4389 bp, Homo sapiens
  misc_feature (18)..(18): n is a, c, g, or t
ggcagtacccccggttantgtagcgaggctgggagcggcttcgcggttcggtcctcgcacccggcagccgccactggtgctgagctgctaggaagcccctatcgccgagctcgttggagcttgaacccattgtcacccctccgttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432182 - DNA, 4453 bp, Homo sapiens
  misc_feature (18)..(18): n is a, c, g, or t
  misc_feature (174)..(176): n is a, c, g, or t
  misc_feature (180)..(183): n is a, c, g, or t
  misc_feature (193)..(195): n is a, c, g, or t
  misc_feature (227)..(227): n is a, c, g, or t
  misc_feature (247)..(249): n is a, c, g, or t
  misc_feature (251)..(252): n is a, c, g, or t
  misc_feature (254)..(254): n is a, c, g, or t
  misc_feature (264)..(264): n is a, c, g, or t
  misc_feature (268)..(269): n is a, c, g, or t
  misc_feature (271)..(271): n is a, c, g, or t
  misc_feature (286)..(286): n is a, c, g, or t
ggcagtacccccggttantgtagcgaggctgggagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaaatgnnnaaannnngggggggggnnntttttttttttttttttttttttttttttttntttttttttttttttttttnnntnntnttttggtaantatnnanttatattattggaantactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432183 - DNA, 4192 bp, Homo sapiens
tatttttctgaaaactactttttagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432184 - DNA, 1706 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatgctcacgcttagtggttccagcctacaacggaagggcccccggccatcttaatggcggaaaccgagccggtccatgacagtaactatcacgagacctgtctttcgcgtgagagaggcaatatagtggtggcgatggacgagaaactggcatctctgagagcccgcgcgagagtagtctcctactactgcagtgatggcgctcggaggcatccggtggtccgacacgacacaagacgaggagggcgccccccttcatactaacggaggggggtagttaccccctcccgtacgaggactgacgtcctagcagccacacacgaccgcggagccagccaccaagggagggctggatggcccgaggacggacagccaccagcttggacgcgggacgggtgaaggaaagcagcaggcaacaacacacgcgaacaacggtatggaccagacgcccccagagcaacaaaacaaagagggaatcgaaacataacaaaccaacgcccggcacacaagaacggagcatgggacatcacgcaagtcccgtccagcccccccaaaggtaggtccggacggcagcacgtaccggctccctgacaccgccgcacccagacggcagtgacacgcagcgcggtccaaa

SEQ ID NO: 432185 - DNA, 4035 bp, Homo sapiens
gcagttgatgtctgaggtcgtctagaggatcccagcggggaacaatcacttcctctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432186 - DNA, 4088 bp, Homo sapiens
gccgggtggtttaatcggccgagggaaatcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432187 - DNA, 4095 bp, Homo sapiens
  misc_feature (12)..(12): n is a, c, g, or t
tggtgagagacnacgacttttggggaatggaaatgtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432188 - DNA, 4040 bp, Homo sapiens
tggcgaattcggcacgaggcctccaagaggtcttagagggcctctacttcttggaggtggtccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432189 - DNA, 4199 bp, Homo sapiens
ctctagaatttccttccccgcccccttttagtttagtgtcctaatctcgtgttcatgaggtgtggggtttataagggactgaatcgaaatgaatgtaacaaaaaagaaaaaaaaaaaacaaaaaaaaatgcctttcctcagggccagtgagtggcaaataatttttaaagaaaagcctataattacatcatctcaataaattttttataaaaaaaaaaatccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432190 - DNA, 3963 bp, Homo sapiens
aaaaaaacaaaacttttagtcatgtgttctaggtgattagataaatggaattagcactgaaaaaaatttaaaatatgaatgggaaattgtagaaaataaaattaggtgatctagcctccgtaatgtcatctttgaagtcagtctcattatttttcatagcctgaatgtaagttcacgttttaacttttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432191 - DNA, 3677 bp, Homo sapiens
cggttgcgacgactgcttgggccccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432192 - DNA, 1114 bp, Homo sapiens
ggtccttcagcctcgttcccgggcagtataaagtttgctgtctcctttgttcgccctcggttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaaaatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagaggtaaatgttccatgtatgatgatttatgctactaccgtaacacaaagaattgagaggtgaatgatgcttaaaattttaattggccaggcgtggtggctcacgcccgtaatcctagcactttgggaggccgcggcagacggatcacggtgtcaagagatcaagaccatcctggccaatgtggtgaaaccccgtctctactaaaaaatacaaaaattagctgagtgtagggcgggttcctgtaatccccgctacttgggaggccgaggcaggagaattgtttgaacctgggaggcagaggttgcagggaaccgagatcatgccactgtcctccagcgtggcaacagagtgagattctgtctcca

SEQ ID NO: 432193 - DNA, 3099 bp, Homo sapiens
gggctgcccagaggattacggcagaacacattcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432194 - DNA, 3177 bp, Homo sapiens
gggcttaagcgatcctcttagcctcccaaagtgctgggattacaggtgtgaaccactgtgcccagcctccatttttttccagttgaagaaactaaggcttaaagaggcttaaataatttgtccaaggattcacatttaactaagtagttaggattgcactcagatttgtcctactctagaggccaaaccctttagacactatactataacagctcttagaactagagaagttggcaagagcaggttttatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432195 - DNA, 2510 bp, Homo sapiens
cggacgctagttctagatcgcgagcggccgctcgctagaactagaaacaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432196 - DNA, 1072 bp, Homo sapiens
cccctacccccgagttctagcaattctcctgcctcagcctgctgagtagttgggatcgattgtgaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggca

SEQ ID NO: 432197 - DNA, 5438 bp, Homo sapiens
  misc_feature (1811)..(1811): n is a, c, g, or t
cttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagttntctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctcttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaaaaaaaaaaat

SEQ ID NO: 432198 - DNA, 3610 bp, Homo sapiens
  misc_feature (25)..(25): n is a, c, g, or t
  misc_feature (51)..(51): n is a, c, g, or t
  misc_feature (137)..(137): n is a, c, g, or t
  misc_feature (210)..(210): n is a, c, g, or t
  misc_feature (238)..(238): n is a, c, g, or t
  misc_feature (251)..(251): n is a, c, g, or t
gaaaacccttagagcagtttccaantgggatttatgtaagagaatgggaantgtgaccaattatctagaggctcacatttctttgtacatatattatatttgagattaatggcacttaaagtccatccgtagaaatntttgtaggtatttgcaaagtactatcagcattttcaatcatatgtgggtttattaaaatgttattctcaggtnccaccagaacaacagaacattcattganggctggtttgagnggaggaaacagctggaggaggatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctcttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaaaaaaaaaaat

SEQ ID NO: 432199 - DNA, 5384 bp, Homo sapiens
  misc_feature (1811)..(1811): n is a, c, g, or t
cttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagttntctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctcttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgctgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaaaaaaaaaaat

SEQ ID NO: 432200 - DNA, 5385 bp, Homo sapiens
  misc_feature (1811)..(1811): n is a, c, g, or t
cttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagttntctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctcttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaaaaaaaaaaat

SEQ ID NO: 432201 - DNA, 1340 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432202 - DNA, 957 bp, Homo sapiens
  misc_feature (10)..(10): n is a, c, g, or t
  misc_feature (12)..(14): n is a, c, g, or t
  misc_feature (20)..(22): n is a, c, g, or t
  misc_feature (24)..(24): n is a, c, g, or t
  misc_feature (789)..(789): n is a, c, g, or t
tggctaggtngnnnctgggnnncngtgaggcctgcggtgcctggacggcttcccgccccgtttcttacctggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatncgctgagcatcaggaggtgcgcggccggtctcagtcctcagtgtgccgggtgtccgggatccaggccgttcctggacttcagccctgggagggagaaggattgttctttttgcctgcaataggtggtttttccaaaaggtgttatgtggtgtttggaaaaaaacggtt

SEQ ID NO: 432203 - DNA, 1380 bp, Homo sapiens
cgaagccgattctcctcctcctcacggtctcgatcaggccagaagcttgtgtcaacgtctgggttcttccccagttttctcttcttcgtggtgatctcttccctttccatctcctcctcatacatggccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432204 - DNA, 1582 bp, Homo sapiens
ccggggcaggcccctggctcgctgacttccagcagggcacacagaagcaagccagcgacagtctcatctgtgaaatgggcctggagccgggcgttctccgaggctgaggccactagctgatgaccggcctccggcaggagggagccgagccagtgtttctgttgggaggcacggcggggacgggcctctcgtcgcctcgcctgggcacccagcgtcctggctctggcccctcggccctcagagccaggcctctgccccctcggccctcagagccaggcctctgccctggtcctatggacaccgggcagggcggttcgtctccccctggagaggcggggaggcctgagccagacctggcaagtccactggccaggaggctccttccagaaccccttgcacctgtgaggcaggcacgaccctcccgggtgccagcggttcacccactgcttccgagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432205 - DNA, 1017 bp, Homo sapiens
  misc_feature (10)..(10): n is a, c, g, or t
  misc_feature (12)..(14): n is a, c, g, or t
  misc_feature (20)..(22): n is a, c, g, or t
  misc_feature (24)..(24): n is a, c, g, or t
tggctaggtngnnnctgggnnncngtgaggcctgcggtgcctggacggcttcccgccccgtttcttacctggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432206 - DNA, 1378 bp, Homo sapiens
ttgcaccctgggggggaccctgtctccagctttgggacaggggtagcatctagcttgcgatttgcatttctctctcccgcctcctcgggtccacgctcacgtcttttcaccatggcggcttgtcttctttctgaccctctaaatgcagtgggccctttcccagcatccggtgcctgagcagcctgcgttctccccattgccagcctgtgcttggctctcccctgtggccctctgtgcttgctgtttgtaacagagccctcgcccatgagctcaaagtgatccaggacagcaggacccgtctggggcaatggggacccagcctgggctgggcaggccccacatagggcacacaggtggctctgggtcaaggaaggggctgggtcagggtcgggaaggacatgatgtgtgatggggccacctgcacctcactaggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432207 - DNA, 780 bp, Homo sapiens
gcggccatgtatgaggaggagatggaaagggaagagatcaccacgaagaagagtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432208 - DNA, 1487 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcacgtgagtcccttcagccccagtacccgcagtgggtgcagcaccctgggctttggctcaggctggtgggggcagtgtgcgcaggcggggggtgtggggaggggccgagatggaccatcaagacgccgctttcctgcccttggctcccagcatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432209 - DNA, 1739 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgagtgtttgcggagtcagacgcgagggcctgggcccaagccagcttccctgtccacagtctcctgggtggtgcgctgagccccaaggctgctctcagtggggctggagaccaagaggcagctctgccttgtagggtgaggagatcgagatcaccttcagctactgggatggctctgggcaccggcggacagtcaaggtaggcagcgtgcagcctgcttcctgctcaccatgggcccagcctccctcaggttccgtgggaaggaactgaccttcctgacttgggaagccccagggatcctgaggataactggctccagggcctggccccctgtctggggagtgagcccaggcctggctgaggctctgcagcgtcgcctggacggtctgggcctctgccttgttgagagcccttctcgcagttccgccttcccttcccaactcctggattcccggatacagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432210 - DNA, 1708 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaaccaaaaaaaaaaaaaaaaaaaaaaaaaaaaaaaaaacacaaaaaaggggggggggccggccccaaagaattcatcccccgcggggggccccagcgttcagctcgccgcactccccccgtttttttgttaaacaaggggggcccccaaatggaggggaccgcaccaaatttataatagcgccagagagcaggcgggccccggcggtttataacaaagccgttgggatcgcgtgggggaacaaagcggctcagaccggcgggaaaccgcttggggagagaggggcacccctctgctagcgggggggggcaccaattactgtggacacaactcccccatcccacagaatataagcgggcccagagggaaaatta

SEQ ID NO: 432211 - DNA, 950 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432212 - DNA, 1641 bp, Homo sapiens
ttgcaccctgggggggaccctgtctccagctttgggacaggggtagcatctagcttgcgatttgcatttctctctcccgcctcctcgggtccacgctcacgtcttttcaccatggcggcttgtcttctttctgaccctctaaatgcagtgggccctttcccagcatccggtgcctgagcagcctgcgttctccccattgccagcctgtgcttggctctcccctgtggccctctgtgcttgctgtttgtaacagagccctcgcccatgagctcaaagtgatccaggacagcaggacccgtctggggcaatggggacccagcctgggctgggcaggccccacatagggcacacaggtggctctgggtcaaggaaggggctgggtcagggtcgggaaggacatgatgtgtgatggggccacctgcacctcactaggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaaggtaggcagcgtgcagcctgcttcctgctcaccatgggcccagcctccctcaggttccgtgggaaggaactgaccttcctgacttgggaagccccagggatcctgaggataactggctccagggcctggccccctgtctggggagtgagcccaggcctggctgaggctctgcagcgtcgcctggacggtctgggcctctgccttgttgagagcccttctcgcagttccgccttcccttcccaactcctggattcccggatacagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432213 - DNA, 671 bp, Homo sapiens
agctgggagtgtaggaagggagaggaggcagtggggagaggaaagggtgggctgctgggcaccggctgacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432214 - DNA, 1164 bp, Homo sapiens
  misc_feature (10)..(10): n is a, c, g, or t
  misc_feature (12)..(14): n is a, c, g, or t
  misc_feature (20)..(22): n is a, c, g, or t
  misc_feature (24)..(24): n is a, c, g, or t
tggctaggtngnnnctgggnnncngtgaggcctgcggtgcctggacggcttcccgccccgtttcttacctggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcacgtgagtcccttcagccccagtacccgcagtgggtgcagcaccctgggctttggctcaggctggtgggggcagtgtgcgcaggcggggggtgtggggaggggccgagatggaccatcaagacgccgctttcctgcccttggctcccagcatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432215 - DNA, 1437 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggtgagtgccgccgacccagccgcccccatagcaccttgccgccgatgttgtcactggggcagcagcgggacattgggctgtcacttctcccctgcaggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432216 - DNA, 1280 bp, Homo sapiens
  misc_feature (1112)..(1112): n is a, c, g, or t
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatncgctgagcatcaggaggtgcgcggccggtctcagtcctcagtgtgccgggtgtccgggatccaggccgttcctggacttcagccctgggagggagaaggattgttctttttgcctgcaataggtggtttttccaaaaggtgttatgtggtgtttggaaaaaaacggtt

SEQ ID NO: 432217 - DNA, 1193 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432218 - DNA, 844 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgagtatgcagagaagaataggacc

SEQ ID NO: 432219 - DNA, 649 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacctgagcaagccaggcctggcttgctcaggtctccggccttgcacaggtcgggccctgccagcgccatc

SEQ ID NO: 432220 - DNA, 833 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatacactcgtgggcagcgctgcccacgaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccacttcgtgggcagcgggta

SEQ ID NO: 432221 - DNA, 803 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 432222 - DNA, 690 bp, Homo sapiens
  misc_feature (547)..(547): n is a, c, g, or t
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagctgccgctggtgccgtgcaaccaggccaaggcgtcggacgtgcaggacctcctgaaggatctgaaggctcagtcgcaggtgttgggctggatcttgatagcagttgttatcatcattcttctganttttacatctgtcacccgatgcctatctccagttagttttctgcagctgaaattctggaaaatctatttggaacaggagcagcagatccttaaaagtaaagccacagagcatgcaactgattggcaaagagatattaaactgt

SEQ ID NO: 432223 - DNA, 564 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaagtgcgcctgggttcgcacccaggcgcacttctcctgctgcagcctcccaagtagctggaatttcaggcgtgtaccaccgtgcccaattaatttttgtatttttagtagagacagggtttcaccatgttagccaggatggtctccat

SEQ ID NO: 432224 - DNA, 567 bp, Homo sapiens
gtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtggactagtagccaaccgtggactagtagccacccgtggactagtagccacccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaacctgactagtagccaaccgtggactat

SEQ ID NO: 432225 - DNA, 7801 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaagaaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatattccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccaatattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggcctgtaaaatagagatggacagaccatgcatgtttccatgaagctatttaatgctgctcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatataatttcaactattttgtacatttaaatatgccatgttgtatatgtctgtatttaaaaatgttgtaaatatctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtgaaaaattgga

SEQ ID NO: 432226 - DNA, 702 bp, Homo sapiens
  misc_feature (663)..(663): n is a, c, g, or t
ctagaggatccctgtgatacgcacaccctgtgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgtgtgtgngtgtgcttcacagggaccgagccgaattctaatcaggtc

SEQ ID NO: 432227 - DNA, 688 bp, Homo sapiens
taaatcttttctatatattatcaaactgctctttgtatttaaagattcaatttgtgtctgtacataaatttctgaattcaaggtcctgggataactggaatctatgaatttaacattggggaagaaatattgcttgtaaaaaattatgctaataagttattgtatcatttaaggatattttatttcagaaaaaaagtacatgggtattatgtattagtattgtatttattacacatttatacattgaaaggggttaaaatttagagatatttcaaatattgaaagttttccccagaaatcttttttcacgtttttatttatccaaaataattgtacttctgtctcttaattagggagatatgcaaaccgaaatacttaaataagacctcagtacgtcctggcctgaagaactgtggagatgttaattgtattggacggattcatacatacctcgaattgataggagcaatcaattttggatgtggtaaaaataaaaacccaacaacatcttttactcgacattttttatccttacagcacttattcatttctatgatggttagaattcaagtagttataggtatatagaattcagaggtgctgtaacattatttaataaatgttttattaagattttactgttggttaaactgtgttttcatttgacctacactgaaaattgagagtg

SEQ ID NO: 432228 - DNA, 7747 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaagaaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatattccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccaatattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgtttagaagttcagttttttcttatgaggctaaaaaaaattaaaacatttttgtgggcttctaaaaaactgtgggccttaggtactgtgcctaatggataagttggcattgcctgtattctgaagggcatcattggaaaaatagcagtcattattctgtccccttctcccaccaccacagtccttggagaagcctttgccactccatccaggagcactgcagtttccacggttatagatctatagacttgaacttacttccttcccaacctaacgaaaactcacaaggattacttgggaccattcatcctcaaaaaagataggaggcagtggtttgttttagtcttcagatatttttgttttggtcagtccctaatctgtagttttgaaactcgtgccacacttgaaagggaaacatcctactacctttctttcctctccatttcccacaaaccctttccttcatcatcactccctgcattcttacttctcagcatataaatacaagacccttctttctattatttgttgaaagctaggccttcccagtcttctgtccataccattccttccctgcccctaggagtggggttgaggtctgtgacatgcagactgtaagcacagtcagaacctctgcagctctcaacccaacagaggagactgtggcttcaacatgccaacctgagcaggtctcctctgcattaccttcctcccatttctcttcctgggtcctgatgaggtgagctggaggaaccaatagtcaggatgccctggaattgatgttgctctgttttgtgctcacaaaacagccatgtaacacatgagcacctgagttgaagccatccagtcgcaagtcagcagacagcagttgatggaattctcagtagaaattcagtaagggtgcccaaattttattttttttttcacctatactctaccaatatatggtatttaggaaaacttcttttatccaagcacaaagaaaagcacacacatttttataatcatctgcttcatcagggtaaataaataatttaacaaatttgatcagcatctctagtttaccagtactttaatattagttttcttacaaattaatgtattttgcaatatttccagaaaatcactgtgggagaataatgtaatatactttaggatatatttcctgaccttttcttaaatggcttcatgtgctattcccccaaattctgctttctctattttcttttttatttaacctataattatactttctagtatattctgagtctatcttctaagccaccttacatttttcctggaacaagggagggaataaatagttgcctccactaaatcaggaaaaaataaaaatatcccaggggagctgtgattatgccaagagctctaaacagaagtttgagaaggtaaaaattaagttgtagtatctgagttgtttttattttcttcctttggtgtttatgaaggtattcataagaactttaatttcaggggaaaaaatgcctgatttgctatttttgacatttcctcgtctcttaagaagtcagttaaatatgttttcatagtttatattcctgtttcatagattactgtgaaacatgtatttaaacctatgaattataaaatagtatttagattctagcgtgagttaaatagattagtcatatatcttttagatttgtggatttgacatgtaaattatgtgttgtgtataagtaagttagttactaaacatatggcatggttattgataaacttgttgctatttttttccaaatgctatcagtgtttgtggacttttaaaaattagtttgaattttggaatgttctgtgataaaatataatttcaactattttgtacatttaaatatgccatgttgtatatgtctgtatttaaaaatgttgtaaatatctgcattttaagaattatgaaagattttcctcaaaaatgacagaactctccatacttaattgtgacacattataagatatctgattttaagcttttggattttgttctaaaaattaagtttaaacatgctgaaaattccataaaaataaaattttgaaaataaagtgaaaaattgga

SEQ ID NO: 432229 - DNA, 5663 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaagaaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatattccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccaatattagacttaatctaattccaaagtaacattcaagaaaagaaaaaccagtggaacaggatcagtaagctcagactctccatctccattattttagccttgaccattcttctctaatccttttaaattatcttcagtttccagttcaagttacattgcttcagttacagtttgtttgaccctgtattcagagctgcattatgattcttgtgggccctagatagttttgccatcttagaccccttcttccatacaaaattaaaagtgatattttacaattgtatctgtatgaaatgaatgtattaatattttagattaaaacattttgttt

SEQ ID NO: 432230 - DNA, 5535 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaagaaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatattccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgttttacagccctttaaaatgataaaaaccattgttaactcacaggcctcataaaacataggctgttggctattattctccaacccttgatctagagaattttaaacattagaattttgttttacatttgttaagctttacgtcatcttcaaatgacaccaaaactcagaattatgatctgcatttaagccaattttaaaataaaataagcagtcaatgctgcctcatttattgaaattcagtagattttagtttatttcttagtagtcagagaattgatttatagctattcaccaaacattcttactaacgtttccttatatctaaatcagattgattctatattttgctttgtttgtaatcaatagccaatgaagaataaggagtattggaagaagcagtgagtcagctttaggtgacctggttcttgtctcaactttgtgatttggggagatacagtttactttccctgagccttaattcttgtgtaactgaagtctaacttaacttcttaatgtccttccagaactaaaattttattgttcattctaatcgttggactactcttgtgaagtttatattttgagttaatacagtttccaaattaacatacatttaaaaaaaaaagggtagtatttttccatttctctgtgtgcacttaggataaacagtgaagtatagcttataaaacaattagtttgagggctgagagtgtaagaggaactataccaaaagtcaggaaacctgagctcttaccctaactctgttaccaactttgctgtgtgaccttaatcaaaacacataacctggaccccatgctcctcaccagtaaatcaagggcctgaattttatggcttagtattcccttccaagctccgaagttgcgtgattctgtgaaaggcagtgattgattcctttgtactcatcttccttttgacctgtttcctcatgatatattggggaacaaatactaaaaagtgttttatactagctttcttgattgacatttccctataatactgatgaatttgggtgatggaaagtaatggaaattgttaaaagttctgctctcaaatctgagtctccttgccctgtgtgccaatgtttaaccatatttgctaatctaagccatattgcgaggatctcaaggatgatacttgtcaagagtttggggccttgagagcacagttttcaaaataatacttagtattttctgactatagagtacatttgtcttgtaaagtatattttaaaatacagagaagtgtgaagtacaaatatctcagtgctactatttaaaaaaacacaattagtatataaatccttccccatttttttgacagtataattttagtatgttaaacttggttacttctttctctcttcctccatcattttccctgcttcctttttcttttgtcatattcttaaaacaattttgcaaccacaggtacccacattgctggcactaccagccttgggctactaccgaggataatggagccagggccttgtagaagcacagaggaagtctagaactgagggggcctatgatacaggaagttcaggaggcagagtctcaaaggaacacctgcctttaataatgtttacagaagtggagaaaggactaaaggacttaaagacatgcaggtgtcttcatcctgattctgtctttgttattgcacaatgactataaaataatgacctaatttttttttttttctggcttggctaatggaaatcgacactagcgcttccccaatattagacttaatctaattccaaagtaacattcaagaaaagaaaaaccagtggaacaggatcagtaagctcagactctccatctccattattttagccttgtcttctccaaaattactgagtaggagtttattttatctttttgagacggggatcactgtcacccagactggagtgcagtggtgggatcttgactactcccg

SEQ ID NO: 432231 - DNA, 1705 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatggtaagaaagaattacattatagatgttgttttaaaacgtgatattctgaagtattttaattaggcctatacagaatttagaattttgctagtaaatctagagatcactacagtagggaagatttaagatttcttgtaatgaaaaaaagctttggtaaacattatcacctataactctcataacccatctttttgcctattcattagattgtgggcctggaataaaagggatagacgattgctttatgaagcagtctcctaggacagcgttaggaagatatagagagaacaccactgcacgggaaaagggaaataattctttccggtttatcatgtactttgagtacaaagatagaaaaatttgatgacagcagtagtattaaatgtggccagattgc

SEQ ID NO: 432232 - DNA, 3618 bp, Homo sapiens
  misc_feature (3579)..(3579): n is a, c, g, or t
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtgaacaggctgtgtataataggccacaaacagttgacaaagtacgaatcagagacagaaaagatgcagtagaagcataccaacttgcccagcgtctgcagtctatgcgtacaaggagacgtagggtccgagacccatggggaaactggtgtgatgcaaaggacttagaaggacaaacgtttgagcatctctctgctgaggagttggcaaaaagaagagaagaggaaaaaggcagacctgttaaatctttaaaagtgccaagaccaacaaaaagctcgtttgatcccttccaactgataccttgtaatttttttagtgaagaaaagcaggagccatttcaggtgaaagtggcttcagaagcacttttaataatggatttgcatgctcatgtttctatggcagaagtgattggtctgttaggaggaagatactcagaagttgataaagtagttgaagtctgtgcagcagaaccatgtaacagtctgagtacaggactacagtgtgagatggatcctgtatcacaaacacaggcctcagaaaccttggctgttagaggcttcagtgttattggatggtatcattctcatcctgcttttgatcctaatccttccttacgagatattgacacacaagctaaataccagagttacttctccagaggaggtgcaaagttcattgggatgattgttagtccctataatcgaaataatcccttaccatattctcagattacctgcctggttataagtgaggaaattagcccagatggctcttatcgcttaccttacaaatttgaagtacagcagatgttagaagaacctcagtggggattagtatttgaaaagacaagatggataatagaaaaatacaggctctcccatagcagcgtccccatggataaaatctttcgccgggattctgacctgacttgtttgcagaaacttttggagtgtatgaggaagactctgagcaaagtgaccaattgctttatggctgaagaattcttgactgaaatagaaaatttgttcctttccaattataaaagcaaccaagagaatggagtaaccgaagagaactgtacaaaggaattgttaatgtgattattttaaagttaagacattttaatcttgacacagtagatcttactttcaaagttataaacttgaagtgattgtagttaacattggcacagctttggtattttttctctatttcacaaaatccaaactttgccacataaatcatgtgaaaagaaagagatacaaatttgttttcatatagtgattatcagagtgttctgcaaaccagggtccaccacggtgttctagtcctttactgagcaatgctgtaggctgtgaaactaagcaacctggtcggctttactgttgtgttcagcttgggatttggactatgtctctaagtcatttcttccctgaactagtcatttatattccattgtggtatctcctatttcatttaaaagcacttccattctttccatatattctgctgagatttgtttatggctataaatgagatatggatgggtggtcactgagataattaatatggtttagaactactgattaataaatctaacaggagaccaggagaggcatgacaagaaaatcttaaaaacaggaaaaacccaaaggagagaactaaattaccagtttctaatcatagatactatcttccatttcattgtatagcagtagtatcataagatatgccattttctcagctatctgaaaatttttaaccaattttacacacataaaataattagcttcaattgtgagtccacttacattagtaggtgtgataaaacctcatttaactggaacataggtaatcataactcaaactttttttctactgcctactactaggagaaagaggcaaatgataataaagctggaataaatcagagatttaatttttaaaacaagcctttcaggacatattacatattcgcccagtttcatatgctttctgaatctataatggaggtcagtgaacttttttaatgtaaagggccagtttgtaaataattttggcttttcaggccacatatgatgtctatgagacattcttctttgtgtgtgtgtgtgtgtgtgtgtgtgtgtgtgtgtgtgtgtgngtgtgcttcacagggaccgagccgaattctaatcaggtc

SEQ ID NO: 432233 - DNA, 1643 bp, Homo sapiens
gttaacaaaaggattaatgggttgcttaaattagtgagcttcatcagttttatttttaattccttgagataatgaattttaaaagcaataaatacaatgctgtagtttttgacttcttttctaaatatttacatggatttacatgaaagaactaaagagatagtatttgtggaaccaatttaaactcttacatgcctttcaggatttgggaatgtattaacacctgctgctttgtatccagtctaagggagcctatttgtttgttatcacattgacttcctttgatgtcttttagtgttaccctcactcagacccaaggattatgtcttttggggctcccatcatcctgagctagagacacgtgacaggggtacactctcctacaaaaccagccagttactcagtaaagtggacgatagaagaaaaagagctgtttgaacaagggctggctaaatttggccgaagatggaccaaaatttcaaagctaattggaagccgcactgttttacaagtgaagagttatgcaagacagtattttaaaaataaggtcaaatgcggtctggataaagaaacaccaaatcagaagaccggccataatcttcaagttaaaaatgaagataaagggacaaaggcatggacaccatcatgtttaaggggacgtgctgatcccaacttgaatgctgtaaaaattgaaaagttatctgatgatgaagaagtagacatcacagatgaggtggacgagttgtcttctcaaacaccccagaagaattctagcagtgatctcttgttagactttcctaatagtaaaatgcatgaaaccaatcaaggagaattcattacttctgacagccaggaagctctcttttctaagtcttccaggggctgtcttcaaaatgaaaagcaagatgaaacactttcaagctcagaaattacactgtggactgagaaacagagcaatggtgacaaaaaatcaattgaattaaatgaccagaaatttaatgaattgattaaaaactgcaacaagcatgatggaaggggaataatagttgatgccaggcagttgccttctccagagccttgtgaaattcagaaaaatttgaatgataatgaaatgctttttcattcttgccaaatggtagaggaaagccatgaggaagaagagcttaagccaccagaacaggaaatagaaatagatagaaatatcattcaagaagaagaaaaacaagcaattcctgagttttttgaggggcgccaagctaaaacaccagaacgctatttgaaaattagaaattatattttggatcaatgggagatatgcaaaccgaaatacttaaataagacctcagtacgtcctggcctgaagaactgtggagatgttaattgtattggacggattcatacatacctcgaattgataggagcaatcaattttggatgtggtaaaaataaaaacccaacaacatcttttactcgacattttttatccttacagcacttattcatttctatgatggttagaattcaagtagttataggtatatagaattcagaggtgctgtaacattatttaataaatgttttattaagattttactgttggttaaactgtgttttcatttgacctacactgaaaattgagagtg

SEQ ID NO: 432234 - DNA, 2615 bp, Homo sapiens
agtgggcatgctgggcaacccctctggcccccagggacagcagcacagggccttgacgcttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagaaataagtggtgatgtttattattctccagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432235 - DNA, 492 bp, Homo sapiens
acataccaaggcaccacacaccacctgtccaaaaggccttcgatacgggataatcctatttattacctcagaagtttttttcttcgcaggatttttctgagccttttaccattccagcctagcccctaccccccaattaggagggcactggcccccaacaggcatcaccccgctaaatcccctagaagtcccactcctaaacacatccgtattactcgcatcaggagtatcaatcacctgagctcaccatagtctaaatgcaatcatttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432236 - DNA, 2704 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432237 - DNA, 2788 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432238 - DNA, 2684 bp, Homo sapiens
actagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432239 - DNA, 2320 bp, Homo sapiens
gaaactccgtctcaaaataataataataatattaggaataggctggcagtaggagtttctatagattgcggtgtttgcaaacaccataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432240 - DNA, 2319 bp, Homo sapiens
gctcggtacccctctccacactggctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432241 - DNA, 1875 bp, Homo sapiens
acatctcaatggtcaatttgggacgccggattgatcagctgccaccataatcatatattgtctcaacatatttctaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432242 - DNA, 1517 bp, Homo sapiens
ttttggtttcccatatctctcttcagaaataagtggtgatgtttattattctccagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432243 - DNA, 1527 bp, Homo sapiens
tctagagtatcccagatccccttccatcctcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432244 - DNA, 1448 bp, Homo sapiens
gccccatgactcttccttggaggaagtggctgtcctgaccatcgctctccttccttcgtctggtagctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432245 - DNA, 1476 bp, Homo sapiens
ggtccacctcagtgcagacctcacggctggcaaaatccaagatgctcactcctgagcatgtgtttattcatccgggatggaagctgggggaagtcccagaaggacgaaccaattttgatgatgacattgcactggtgaggctgaaagacccagtgaaaatgggacccaccgtctatccaatctgcctaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432246 - DNA, 1310 bp, Homo sapiens
tctagaggatccctttctctgatcgctcatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432247 - DNA, 1327 bp, Homo sapiens
gcagctcgtcgaaacgcagtgttcggagtcatgtcgcaaaattggcttcataataatttggggttagggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432248 - DNA, 1247 bp, Homo sapiens
aagtatcagtgttttgaaaatccaggaaaaatatcaggatggggccggggctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432249 - DNA, 2736 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaatttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432250 - DNA, 2732 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaagaccccaaaagggaaaccgagctggaat

SEQ ID NO: 432251 - DNA, 2732 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaaaaaaaattataaaatataatattaaaaa

SEQ ID NO: 432252 - DNA, 2742 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaagtcgacgcggccgcgaatttagtagtagtagtaggcgg

SEQ ID NO: 432253 - DNA, 2694 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagttctcactcccgggatacctctagagtcagc

SEQ ID NO: 432254 - DNA, 2710 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaagtaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagttccgccaatagagcaaagacgacgtttaaaaacagaccccaaaaga

SEQ ID NO: 432255 - DNA, 2588 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagaagcttggttaagtaaagttggcacaagagggggcggggggggacc

SEQ ID NO: 432256 - DNA, 2271 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctggtgatggtatatgcagacggggctccactatctatttatcagacgtgc

SEQ ID NO: 432257 - DNA, 2143 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaataagcgatgaggcgtagttttt

SEQ ID NO: 432258 - DNA, 1960 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagtgtcacacggatcccaccaaggaccataggtacacatgccgactcatcagcccagagactggaacagtatgggcctcttcctccgtcggggtcgacagtaagtggtgttgaggtagcgctctgttagtagcatattaataccagctgataggacttggattagtactacctggttaggtctacctg

SEQ ID NO: 432259 - DNA, 960 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagtgtggaggggatcctctaggacagccca

SEQ ID NO: 432260 - DNA, 231 bp, Homo sapiens
cggactataactgaacaggctctgattccatttctggttcctcttccctttgctcatcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432261 - DNA, 532 bp, Homo sapiens
gacattgagctgtcagagaactgtgcgtatgactcagtgcaggtatgttataagcacaaaaagaatagagatggaagactagggctaaggtagcggaataaggatgtgggagggagtgccacctgtactcacagtgaactggagtcaagtcctagtggcataaatgttctattctctctgtcccttcttttaactccataccaaaatattaccctttcctagattttttttttgtgactcttctcttagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacaggtaaggctcacccttctgcatgtgccttattgacccagctaaaagattagaaatgagaaatccactgagcaacacattgaatgaggattctgttcgtaattctta

SEQ ID NO: 432262 - DNA, 692 bp, Homo sapiens
tgtgtagttttctcgcccctgtttcaacctcctcccacgttgagtccccagagtccattatatcactctgtattggcatctattcttagttactcataagctgagatgaagccacaagaaggaggaagataagactatagggtaaagttagttaattggataagagagatagatgcctgtaaagggtctactgggggctgttcataaccagaaaggctccatcctaagcaaagtgatggaaacctaatagggattgggtattcctactgatacgtattgcacgtgtaattgctctatccctccagttagggcagggatctcaggttagtttgaatgcaggactgtcagtttctgagagaaggaatcatagaatagtgcaggaattcctttgcttgaccctgtatttgattctccctttctctttttctctgttagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagttgtgcgtgatggttgattaataccccacccttaacttacacagagagatctctccctg

SEQ ID NO: 432263 - DNA, 2739 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432264 - DNA, 2579 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432265 - DNA, 2295 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaatcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 432266 - DNA, 1738 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggagggccgtccactccgaatcggagggtgaactcttcgcattctttctgacagctccggattctgggtcaactgtgccgc

SEQ ID NO: 432267 - DNA, 1060 bp, Homo sapiens
atgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacc

SEQ ID NO: 432268 - DNA, 1542 bp, Homo sapiens
  misc_feature (1427)..(1427): n is a, c, g, or t
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttggnttgggtattcctgtcagtctcgtgttggttgggtattcctgtcatctcgtgttggttgatattcctgtcatctcgcgccggttggtatcctgtccgatcctctagatcaccccag

SEQ ID NO: 432269 - DNA, 752 bp, Homo sapiens
aagggggaggggccttgactcagcggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgaggttaatttgtaacccagccaaagaacctaggaggatggagggaagccgtttttccctctcctacacctcagtaacctactgccagctgaagaaatagaacattactaaagccacctgtacatctttctccttttgaattacctgccctccgaagaagtaatggattttctgaatttactgttaacttttaccatgcagctttctatatcttaatgacatattttaatatattaatgacatgaataaatccctgaatgaggatattgtactattttgcatgttttaaccgttaaatgaataattatatgtgcatctggcttttttcaatcaatattgctgtggttcatattgatatgttcataatagtaacttgcacttaattaacctttattatgtgccagacaccatgctaagcac

SEQ ID NO: 432270 - DNA, 656 bp, Homo sapiens
attctcctgccctgcctcccgaatagctgggactacaggcgtccaccaccactcctggctatttttttgtatttttggtggagacagggtttcaccgtgttggccaggatggtcttgatctcctgacctcgtgatccacctgcctcggcctcccaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatatactctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatgagccaccgtgcccagccataggcaacatttttattaaaacagtccagataccttgagcc

SEQ ID NO: 432271 - DNA, 619 bp, Homo sapiens
taccaagacaacttttattcaccgtatatttcctcccctcacctttccacaactttgtggccaccatcccccagaaagccgcaagcccccatttcttgagtagcgtaggatgctgtataatattcaatcatctgaccatggtgggactcctctgcgtatgtaattaagtacgggttttttttcttgttaatgtctatgtcaggttaatttgtaacccagccaaagaacctaggaggatggagggaagccgtttttccctctcctacacctcagtaacctactgccagctgaagaaatagaacattactaaagccacctgtacatctttctccttttgaattacctgccctccgaagaagtaatggattttctgaatttactgttaacttttaccatgcagctttctatatcttaatgacatattttaatatattaatgacatgaataaatccctgaatgaggatattgtactattttgcatgttttaaccgttaaatgaataattatatgtgcatctggcttttttcaatcaatattgctgtggttcatattgatatgttcataatagtaacttgcacttaattaacctttattatgtgccagacaccatgctaagcac

SEQ ID NO: 432272 - DNA, 731 bp, Homo sapiens
aagggggaggggccttgactcagcggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgaggaagccacttggaggatgtgctttaccaaaatgagggagtaatctgagaaggcatgggatcctgaaactaaaagatgtcacaaaggaaaacgaggaaagtcccaggatgactactgtgtcaagtaagtaggacagaggttccaggaagtaggtatctaggaaaactgggaacaaagtatttgagtacaatggaaagtgtataaataagcaggaaatttgaaattttatttcttagaaagtatgttatttagtaatcagttttttaaaaatttgacattaaaagtataggcaaattggagtcttgtcagctataattagattggtccttacggcataatactccacaattgcagtagatgctgacttcaataagatgtgcgccacagaagatatttt

SEQ ID NO: 432273 - DNA, 528 bp, Homo sapiens
aagggggaggggccttgactcagcggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgaggttagtggagacggatgctgtcttttgaaggccttagtccctgccctggtgaagccgactgcgaggttccacagggcgtgcaggcagtccggggatcgttgcgaaggggggtgcgggctaacttagctgctgccgtttctagatgtgcagctgtgtaggccctgtttacaagtgtgcataaggacagtgtatt

SEQ ID NO: 432274 - DNA, 4502 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaaggtaaaaaaaaaaaaaaaaaaaacttttatagctctctatttggagtttggggcataagggatcagcttttgcaaaagtaattttctaggctaaaactgcatacaaactggcccagttatgtaccaacaaagaattaaaatggccccagactttgctccccaatattgtgattgtaagagctattaccaacaggtaaattggcctaagtctgtgagatagagagggaagagtctgtaagacttcttgctcagcatttgttctgattttagatatcttgaagttaggtaggcaataatgttatccagtgctttcaggctttaatatcatgtctctagtcttctcattcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgc

SEQ ID NO: 432275 - DNA, 4157 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaagcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgc

SEQ ID NO: 432276 - DNA, 2997 bp, Homo sapiens
aagggggaggggccttgactcagcggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttatatagaattggtgataggatcacaacttctgaggtcccagcaagagtcctaacatctagcagctctaccaccaggacaggccccctaaaactaattccaacaagcacctctgaagcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgc

SEQ ID NO: 432277 - DNA, 2878 bp, Homo sapiens
aagggggaggggccttgactcagcggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgc

SEQ ID NO: 432278 - DNA, 4887 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaaggtaaaaaaaaaaaaaaaaaaaacttttatagctctctatttggagtttggggcataagggatcagcttttgcaaaagtaattttctaggctaaaactgcatacaaactggcccagttatgtaccaacaaagaattaaaatggccccagactttgctccccaatattgtgattgtaagagctattaccaacaggtaaattggcctaagtctgtgagatagagagggaagagtctgtaagacttcttgctcagcatttgttctgattttagatatcttgaagttaggtaggcaataatgttatccagtgctttcaggctttaatatcatgtctctagtcttctcattcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgcaaaaaaaaaaaaaaaaaaaaaaaaaaagaggggcgcgctaaaatttctcccccggggggcccagtttagctgtccccaggttttcttggtcacaaggtggcgcccctaatagggagtcgtataataagctaaggcactggggccgccgtttaacaccgtcgtgactggggaaacttcgctacctggggactcttggtggaggggacccttacttctggcgggtggtggacctctatctcgcgccaaattacctagagagatttaaaggctcctagcgtaacttactaacctcttcaagcgtgtctactgtgtcaacctaacctggaatatggctggcgggctgagagtttcggtaacgattatgctcttggacattttttcgtgc

SEQ ID NO: 432279 - DNA, 4614 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaaggtaaaaaaaaaaaaaaaaaaaacttttatagctctctatttggagtttggggcataagggatcagcttttgcaaaagtaattttctaggctaaaactgcatacaaactggcccagttatgtaccaacaaagaattaaaatggccccagactttgctccccaatattgtgattgtaagagctattaccaacaggtaaattggcctaagtctgtgagatagagagggaagagtctgtaagacttcttgctcagcatttgttctgattttagatatcttgaagttaggtaggcaataatgttatccagtgctttcaggctttaatatcatgtctctagtcttctcattcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaactacacaaaggaaaatggcagggctatgaatttctttcccagcttttatatagatgtgcctacatatgacactctttagggttccttttattttttcttttttttttttttttgaggtagttgaattaaactgggtaactacacaaaggaaaatggcagggatatgaatttctttcccagcttttatatagatgtgcctgcatatgacactctttagagttcctttcactttttcttttttttggaagggggcggggaggcaggaggagtgcagttttaagcctagcctatactactacaaacttattatggtacttaaaattacagcatgaacgttctatatcggagtctcccaccaggctgtctctgactaaatcagcctataagatcatcccttgggattaaacaaacacctgttctgtagggaatgtgtttcctgaatcttggtactcagacttttgtcaagagtaaataacatttcaaaagatgaatggaaaaatgattaagagagcatttctgctttcagcattaactgctaatggattaaaattttaatctgtatagcatttcctggagtaaaagctcaagtactttccacatccattgcaaacttttcaggaacccttctaatttttttt

SEQ ID NO: 432280 - DNA, 4452 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaaggtaaaaaaaaaaaaaaaaaaaacttttatagctctctatttggagtttggggcataagggatcagcttttgcaaaagtaattttctaggctaaaactgcatacaaactggcccagttatgtaccaacaaagaattaaaatggccccagactttgctccccaatattgtgattgtaagagctattaccaacaggtaaattggcctaagtctgtgagatagagagggaagagtctgtaagacttcttgctcagcatttgttctgattttagatatcttgaagttaggtaggcaataatgttatccagtgctttcaggctttaatatcatgtctctagtcttctcattcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaatgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtagaaagtgggctagtgatgttttggttttatggcggaatcctgtgaatacggttgctgatcatagggggattgctatacccaggtttattgatagttgtgtggtgggtgtgaatgagtgtggtagtaggcctaggatgctttgttgagcctatgaatataacttacggcagatatatagtattagtgatcagggctcttcctattttccg

SEQ ID NO: 432281 - DNA, 1357 bp, Homo sapiens
attctcctgccctgcctcccgaatagctgggactacaggcgtccaccaccactcctggctatttttttgtatttttggtggagacagggtttcaccgtgttggccaggatggtcttgatctcctgacctcgtgatccacctgcctcggcctcccaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatatactctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccagcagtttgggaggctgagggcaggtggatcacttgagatcaggagttcgtgaccagcctggccaacatggtgaaagcccatctctactagaaatataaaaattagccgggcgtggtggcatgtgcctgtagtcgcagctacttgggaggctaagacaggagaattgcttgaacctgggaggtggaggttgcagtgagctgagatcgcgccactgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgc

SEQ ID NO: 432282 - DNA, 2860 bp, Homo sapiens
atgtggaattttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaataataaatacatggtggtcaggaactaacaaaagttatccacattcaataaaattctctctttttttcctttagttctggtaatttatacttttttttaatttgagctattcttactttcctgggataggccatatttgataataacattctttttaatgtactgttggattctgttaagtgatatttaggattttgcaagtgaagtgagcctatacttttcttgtttggttcatctctaagtttgggatttatttttattatctttataaaagtagctggtcagttttcatgcttttttcttttttgtggaacagcttatatagaattggtgataggatcacaacttctgaggtcccagcaagagtcctaacatctagcagctctaccaccaggacaggccccctaaaactaattccaacaagcacctctgaaggtaaaaaaaaaaaaaaaaaaaacttttatagctctctatttggagtttggggcataagggatcagcttttgcaaaagtaattttctaggctaaaactgcatacaaactggcccagttatgtaccaacaaagaattaaaatggccccagactttgctccccaatattgtgattgtaagagctattaccaacaggtaaattggcctaagtctgtgagatagagagggaagagtctgtaagacttcttgctcagcatttgttctgattttagatatcttgaagttaggtaggcaataatgttatccagtgctttcaggctttaatatcatgtctctagtcttctcattcttctcatcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggcaggcagctatctctctagcagatgactgaagccttattgtctggagaaattaaaccaaacagacttagaactgaggacagggggaggatggtaatggtagtgatgtgctatatggaagacaaaatgattaacagaatgaagccacttggaggatgtgctttaccaaaatgagggagtaatctgagaaggcatgggatcctgaaactaaaagatgtcacaaaggaaaacgaggaaagtcccaggatgactactgtgtcaagtaagtaggacagaggttccaggaagtaggtatctaggaaaactgggaacaaagtatttgagtacaatggaaagtgtataaataagcaggaaatttgaaattttatttcttagaaagtatgttatttagtaatcagttttttaaaaatttgacattaaaagtataggcaaattggagtcttgtcagctataattagattggtccttacggcataatactccacaattgcagtagatgctgacttcaataagatgtgcgccacagaagatatttt

SEQ ID NO: 432283 - DNA, 1227 bp, Homo sapiens
ggggcttatacccagccctgctcacctgaccgaaaaagacaagcagtaaaaaaacagcttgaccctcgattatttgttacagtgaaactgagagtccacaaggcctgctccttcatatacagctttcagtcacttggaatcactgtacacagatagccaaggatcactagatatttgaggaaaccttcaacatgaaagatgaacataaagaagctgtgatattctcagaaaggaatatactgcttccatcaaataggatcaggatgctattttttcagtagatgtattagaaaataacttgaagaaattttaaaaagtagaacaaagagatgaaaagcaggcaagaacaaaaaagaaacttaaacctgaataagatgcaacatctaataaatgagttccaaaatgagagaacagagaaagaaggtgaagagagaaaaaaattaaaataacatttcccggaaataataagactttagtcttctaaattaaaagggtccactaagtgccctgtgaaatgaattaaaaaataccaaagcacattgttaggatatttcagaatgctagagttatggaaggacctaaaagcttcccaataaatgtagcggagaaagttacataaaaaggatacgttttcaaaatggcatttagatttcttggtagcaacactggatgcggaaagactatgaaagcaaggtctttaaatttaaaaagaaatgatttccaacgcagaattttgtactcaaataatccaatcaagagtggggctaaaataaagataccttaagacttgcatggtctcagaattttatctcaccatctaccttttcttaggaagccacttggaggatgtgctttaccaaaatgagggagtaatctgagaaggcatgggatcctgaaactaaaagatgtcacaaaggaaaacgaggaaagtcccaggatgactactgtgtcaagtaagtaggacagaggttccaggaagtaggtatctaggaaaactgggaacaaagtatttgagtacaatggaaagtgtataaataagcaggaaatttgaaattttatttcttagaaagtatgttatttagtaatcagttttttaaaaatttgacattaaaagtataggcaaattggagtcttgtcagctataattagattggtccttacggcataatactccacaattgcagtagatgctgacttcaataagatgtgcgccacagaagatatttt

SEQ ID NO: 432284 - DNA, 1165 bp, Homo sapiens
atttgcaaacacaaattttttaaatgctgtctcaacagcaggtagtttgggtttgtggtttgttgtcgttgtgagatggagactcaccctgtcgccaggctggaacgcagtggtgcgatctcggctcactgcaatctccacctcctgtgttcaagcaatttccctgccttggcctcctgagtagctgggactacaggtgcgcaccaccatgcccagctaattttttgtattttagtagagatggtttcaccatgttggccaggatggtctcaatctcctgacctcatgatccacccacctgagcctcccaaagtgctggaattacaggcgtgagccaccgcacctggccatctgtgtgtgttttaagcagttactttctcactcttctttaccatgaagggaaagtatatcactctttaaaaacaaaaaatactcgataggtagcacagttatgatacccattcttcatcacagaaaaggttcacaaatttggaacacctatctttgccttccagaacccccaaaagacttgaggatttaaaggcacaaggtaccctggaaggtgggagtaataaagaaagttgaaacaaggggattatttgaacatttatttttgctcttcttttgtaggcaggcagctatctctctagcagatgactgaagccttattgtctggagaaattaaaccaaacagacttagaactgaggacagggggaggatggtaatggtagtgatgtgctatatggaagacaaaatgattaacagaatgaagccacttggaggatgtgctttaccaaaatgagggagtaatctgagaaggcatgggatcctgaaactaaaagatgtcacaaaggaaaacgaggaaagtcccaggatgactactgtgtcaagtaagtaggacagaggttccaggaagtaggtatctaggaaaactgggaacaaagtatttgagtacaatggaaagtgtataaataagcaggaaatttgaaattttatttcttagaaagtatgttatttagtaatcagttttttaaaaatttgacattaaaagtataggcaaattggagtcttgtcagctataattagattggtccttacggcataatactccacaattgcagtagatgctgacttcaataagatgtgcgccacagaagatatttt

SEQ ID NO: 432285 - DNA, 1231 bp, Homo sapiens
  misc_feature (31)..(31): n is a, c, g, or t
  misc_feature (40)..(40): n is a, c, g, or t
  misc_feature (58)..(58): n is a, c, g, or t
  misc_feature (67)..(67): n is a, c, g, or t
  misc_feature (74)..(74): n is a, c, g, or t
  misc_feature (76)..(76): n is a, c, g, or t
  misc_feature (103)..(103): n is a, c, g, or t
  misc_feature (112)..(112): n is a, c, g, or t
  misc_feature (145)..(145): n is a, c, g, or t
  misc_feature (163)..(163): n is a, c, g, or t
  misc_feature (181)..(181): n is a, c, g, or t
  misc_feature (295)..(295): n is a, c, g, or t
agatccggacgctggccttgatggggcctcntggtcttcntgggcaaattggcccacntggagctcnagggatncnaggccagaagggggagattggactgcnaggccctcnaggacacgatgggaaaggacctcgcggtaaacnaggagacatgggccctcntggtccccaaggcccccnaggaaaggatggacctccaggagtgaagggagaaaacgggcacccagggagcccaggagagaagggggaaaaaggggagacaggacaagcaggctcaccggttcctgggctgcnagggccagaggggcctcccggacctccggggctccaaggtgttcctggaccaaagggggaagcaggactagacggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatgatgcggccgaaaatttcattaaaactctattaaagacaatgccgacaaatgc

SEQ ID NO: 432286 - DNA, 894 bp, Homo sapiens
agaggggcctcccggacctccggggctccaaggtgttcctggaccaaagggggaagcaggactagacggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatgatgcggccgaaaatttcattaaaactctattaaagacaatgccgacaaatgc

SEQ ID NO: 432287 - DNA, 888 bp, Homo sapiens
gccttgtgctgagtggcttacccgtgagcagccggcactccatagggccacagcagagactgtttcttcgtggcacggaaggacatctctgcttgctggtcccatgggctaggacagcccctattgaccttgcactatagctgcatgtgacctttaaccaatggtaaaatagccggatttgtttccacctccttctgaggttctgacctgtagtagagaaaagaaatagacaagcgtgggtgggccacatcctgatcagctgccaaaatgcgtgtggcccttgttacccctgtcctgcccacttggtggaccattgcaggaagtctgagccctctgccttcctttctccttgcagggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaacctgcatattttgtacagaaaatatcaacctcttcccttttgtttacaagatgttttgtataagcctatgtctctaatacattttttgtttggtcgtaatgtctgcatgatatttgtgcacatttattaagtatcgaagcttaataaattattgtgtcctggtgccaaagggggccagccagaactgaggtgctggctagctcatgtgtgaattcacataaatgtagaggtccatgatatttgctaagctaggtgtgtctaagagtattttaaacccttatggattttcattattaaaggaaatgaaacatgatgcggccgaaaatttcattaaaactctattaaagacaatgccgacaaatgc

SEQ ID NO: 432288 - DNA, 336 bp, Homo sapiens
gaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccagccagaactgaggtgctggctagctcatgtgtgaattcacataaatgtagaggtccatgatatttgctaagctaggtgtgtctaagagtattttaaacccttatggattttcattattaaaggaaatgaaacatgatgcggccgaaaatttcattaaaactctattaaagacaatgccgacaaatgc

SEQ ID NO: 432289 - DNA, 313 bp, Homo sapiens
ggggataagggagaccaaggagcgcctggattagatgccccctgcccattggtatgtttttgtttatcacttgcattgttctggtttttgttcttgaggtttgtaagttggaaacaaagaaggcaaataaactaagatgagaaccaaatgtctacacggatgctaccaaaatctctctgttcatttgactggtgaaattctgcccgctgttggatttgctttgtaaccacagctgcaagtaattctggctaaatcccttgcctttgaatccttttcctttgaagatacagagcaatcgatgtgtggaagtgag

SEQ ID NO: 432290 - DNA, 3690 bp, Homo sapiens
tgaggcggttgctcccctgccgggtgtgttagaagcaagttagaggaagaaggtcttggggactacgggcgccaccgagaacccatacgaggcaaagaactagggggacgcggggcaggtgctgtgggagttggctggacctgtgggatcgacgtctgcgccgtccaggagccgcccaggggagagagcggagactcgggaggaggatgtgcgctccgacccgggcaaggcttcccatccctcccttcctcttctctccttccctccacctgggctcggagtcaggatctgaccgcgggctctgcccaggaagaccgagttccttgagagcgacacctaagcgccggggaagacagggatagaagagacgacagccctttgataagagggtttttagactaacttccagctgtgacgagtgcatggggcctgcgccctgagaggttgcctttccttttcctctcccagcctgggggtttgtggtgatgttaagttctgttaggaccaaggtggatctcagtaaggaggtagagtagatttgtgaacagctgtcggaggtagaatctttgcagacccagagtgggtgggtgtagacactctgccatgggtggtagctttatttgtaatcctcccagtgaaagctttgggaaatccagccctcccaaactcttgcctttcttgtaagactttctaagcgcatggctttgtcgtaagacttctcgtggccatgtgtctcaccctaccgttcgtctcaccaatgaaccagagctgggataccagcaaaaaggacccaaaagactgtttcaccacaattgaagaggtcgtggaccatcccccaaaatgaatcccaacactggaagaccaagagggttgacgtttgctatcttgaaagctgcagcccccgtagagaagatcctagagcagaaggagcacaggctgggctgccatagcatggacccccaaaaagccactgtcatgaagaaatatcctgtgaagaaaatctttgcagggcacctgaactcccaaagccactgaggagaaggtaagggagtactttggtgagtttggggaggtgaatttctccccaggatatggtttatgctccccaccagccaccagtggatgcttttttctgttttccttggctggtggagttgtcagtggagctgctctcacctcctttcttgcctttggagggccgccttttctgagttccctttagggcctgagccaggggaaggcattggccctgagctttgcctgtgtttccagatggaggccattgaactttcagtggatccaaagtctaacaaaagacaatgtcttgttttcgtcaccccccaaagaagaggaacctgtgagaaatattctggagaaatttaacaccatcagtggaagcaaggtgaggagtctctacctccatgtgcctcccctcctgcctctggagaggtagccctttggttaatggcaacccaatagggtaaccaaccatcccattttagcattgagagcattgtgtcctgggagacccttccctggaatgtaaataatcctggttttagcaacaaagtgtggaaggttggaggaaatgcacaaaacccgtaagttttagagggtctgaaagcaacattgtctatcaaatggatacggcacagattattcatctttacttgttgtcacccatttgaccactgatattggcaaccataatttgtagttcagaatggtcatccatccatcgttgcatcattcaaagtgatgtggcttaagtgtatataatgattattaatagttcatcttcgactttgcctgtggattaattggtgtgctttgtaacaagatagtgctagtttaattttttaacattgtgaatattgtgaccatgttttctaagaggtcagataatgagaatggttataataccaatgcaaccatgaccccatcactgaagaagaaggctaaacgactatgtaattttgatgatggatggaaggacacatactactgaactaggaaggtaaataaccaaaacagagcatactacataatatacagaaaaaaatttgagattggacatggtggagaaggggatgtgcaagcacatatggagggcaaatctcacaagtaagatgggacaggtgaatgcttctaaaccaatcaaaaatacctttgtttccccaaaagacaccaatgctcagtcaaaaatagcagctgctgaattagcatgggcataccaggcaaataagcctgcattgtcatagcgttcccttgattgctctatgaaactgagtaaagtttcatttcctgattcaagaattgcagctaaaatatcctctggacaaagaagaagggaaattttttgataacagatgtgttggctccttacagtataaagccaatttctgtcatatctcaccaacaatcctggtttctacagtacatcaattttaagtaatatgccaaatcatggcagcaaaaatatgttccctctagctgttaggtactttgacttgaaaacaggagtttcaaatcatcttcttcatttctgtgaggattttaatgaaactgctgaaatcataaaatattgttgatattttgtctaaatacaaactagacttagctcatctatctgtgtattcgtcagacagtatagatgtaaaattttggcaaattgcattcagtctacaaacttcttaccaaagaaaatgaaaagatcttatccattcaatgccttgtacatcttatatacaacactgctaaaaagggatgtgagttgcttaaatgtgacattgagactttcataatgaaagcttttggttacttttcaatttcctcaaaaagtgcaaaagcacttatggagatttttgacttcacagaaatggaaggtaacctctttagacgtgtgcctgcaagatggctgtcattgtagtgagccatagaaacgatgctaaaatgttggcctgccataagatcatattttcaaaggacaagaataatgtcctttgacattgtttgaaatctgaaaggagaaaaaaatcaagaatctgaagtgggccttaaaaaaatcagtaagtcccttgtgactctgatttttatgaatctgtctctcaaaagccagggtgcccccagaagaactgagacaaactgagtttctgaacatttgaaaatgaggagcaggctcaggatccacagggtgtaaccatcccgtgaggccctgcctgagcagccagccagtcagtgaggctcttcaccttacttccatttctctgattccacctatgtacaacttacgaaaacttgcattattatagactgggagttcttaaattggaatctgtgaatctaaaggggccagaggatagaaatcaggaaatctgaaaacttcgatggaaaaaagaagtttttatttatttccatcaggaaaataggcaacaaaccacagcagtattagtacctgtgtctctgtcatcactaggaatcacagatatccacgttacagatatcttaaaatatttatgtacagcaccactctgaaattatggtaataattagatccaccccctaggtcttgtaatctttaatatgttaataaagaagcacatctattatgtgacagatttaaatgtttaagaatttgatttcaatgaaattgcatttcaataaaattggcttcctttgcaaaaaaaaaaa

SEQ ID NO: 432291 - DNA, 843 bp, Homo sapiens
ggttgctcccctgccgggtgtgttagaagcaagttagaggaagaaggtcttggggactacgggcgccaccgagaacccatacgaggcagccgccgacggcgggtcgccggggcggggccagaacggcgccaaggccaaccagaacggcggcaagaactagggggacgcggggcaggtgctgtgggagttggctggacctgtgggatcgacgtctgcgccgtccaggagccgcccaggggagagagcggagactcgggaggaggatgtgcgctccgacccgggcaaggcttcccatccctcccttcctcttctctccttccctccacctgggctcggagtcaggatctgaccgcgggctctgcccaggaagaccgagttccttgagagcgacacctaagcgccggggaagacagggatagaagagacgacagccctttgataagagggtttttagactaacttccagctgtgacgagtgcatggggcctgcgccctgagaggttgcctttccttttcctctcccagcctgggggtttgtggtgatgttaagttctgttaggaccaaggtggatctcagtaaggaggtagagtagatttgtgaacagctgtcggaggtagaatctttgcagacccagagtgggtgggtgtagacactctgccatgggtggtagctttatttgtaatcctcccagtgaaagctttgggaaatccagccctcccaaactcttgcctttcttgtaagactttctaagcgcatggctttgtcgtaagacttctcgtggccatgtgtctcaccctaccgttcgtctcaccaatgaaccagagctgggataccagcaaaaa

SEQ ID NO: 432292 - DNA, 2825 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgt

SEQ ID NO: 432293 - DNA, 400 bp, Homo sapiens
tctagcctctttcactcagatcagtcattaatttccatgttattatttaatgctttttctatttctaaacagaacaatgacaaaagtgaatttctgtcaacagcacctcgtagtctaagaaaaagattaataggtacgtatttgtttttacatgactttttataaaaagtagcatctaaacaagaggcaataatagttaagtatataggttctagacttagactgcttggtgttttgaatctttggcttttagttgcaacacttagcaccatgtctttcacattgtagtcagtgtatattgaagtcagctaaaaggtctttccaatgaaataacatgccttttaattgttttgagacagtttggaaattaattctattgatttatttggaaattttataa

SEQ ID NO: 432294 - DNA, 3384 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432295 - DNA, 3526 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcagcatttctcactcatttcttatcttgtaaacctctttcatgaaaatatttccaaaaatccttggaatttttaaataatttttcttgtggcatataattaagtaattttggccaggcataatggcttatgcctgtaatcacaacactttgggaggccaaggcaggaggatctctggagcccaggagtttaagaacagcctgggcaacatggtgagaccttgtctctacaaaaaatttaaaaaatcatccgggcatggtggcccatgcctatagtcctagctgctgtggaggctgaggcaggaggatcgcttgagcccaggggttcaagattacagtgagctatgattgtgccactgcacttcagtctgggtgcagagcaagaccttgtcttt

SEQ ID NO: 432296 - DNA, 3360 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcagcatttctcactcatttcttatcttgtaaacctctttcatgaaaatatttccaaaaatccttggaatttttaaataatttttcttgtggcatataattaagtaattttggccaggcataatggcttatgcctgtaatcacaacactttgggagacaataaagccggtattttacgaggcccgtggaatcaaaaactgcaattagtaataaaatatgatgatatct

SEQ ID NO: 432297 - DNA, 3901 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggtatccaatatttatgacattcaattgtgtaatttttgttttaccctgtacatttcctgtctctggaatttaatgacagcagtgcagtttttcacagcagtgagtaagtggtcactcatgatgggtatgtctgccacatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432298 - DNA, 3848 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggtatccaatatttatgacattcaattgtgtaatttttgttttaccctgtacatttcctgtctctggaatttaatgacagcagtgcagtttttcacagcagtgagtaagtggtcactcatgatgggtatgtctgccacatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggaggtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432299 - DNA, 2879 bp, Homo sapiens
aacaatttctatcacagttcctgtgtgtcaggaattattagtggctttatatacatttcaatgtaatcttcctaatggtttattaaactatgtactattaatttgataaataaactggtgctgagagaatttgttaattagctctggtgaaatcatgagcaggtaatgacaaaaccagaattcagactcttactacagagcccccactctttgctttaccccacaatgcctctcttgtcaaaccatgaaattgtccaaattgctatttttccccccacagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432300 - DNA, 2844 bp, Homo sapiens
ggaacgttatcgggaatctcaggatcattcttcaactgaaatgaaacacttttttttggtgtttttgctagttctgaagctaatttagccatcttttcagagtgttttctattctgaaaagaataaactttatttccaccacctgtagcagagccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432301 - DNA, 3074 bp, Homo sapiens
ctggatgtcagggttgcagtgagctgagatcaccccactgcactctagcctggacaacagagccagaacttgtcttaaaaaacaaaacaaaacaaaaagctgctttctgtagggcctgacttcagtgctaatcatgtctattttatgagtaaatgacatatcttctcaaataaattacatacccctaagcaatcattattttatcctatactactttattttttaatacctaggcattgtgtatggtagaggaaataatcactgaaatatcactaaaaataataattgcagctggacatggtggttcacgtctgtgatcctagcactttgggaggccaagttgagtccaggagttcaagaccaacctgggcaacttagtgagaccccgtctctaccaaaaaaacaattagccaggcatggtggtgtgcgcctagttccaggtaatcgagaggctgaggtgggaggattgcttgagtccaggagttggaggctgcagtgagctatgattgtaccactgcactctagcctaggcaacagagtgagaccctctaaaaataataataataataattggatttcttttctttttagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggtatccaatatttatgacattcaattgtgtaatttttgttttaccctgtacatttcctgtctctggaatttaatgacagcagtgcagtttttcacagcagtgagtaagtggtcactcatgatgggtatgtctgccacatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432302 - DNA, 1478 bp, Homo sapiens
aatataccacgagatccgcctacctacgagctccacggctctatttaaccccaagagccattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432303 - DNA, 1412 bp, Homo sapiens
tgacaagcacgtcttttcaacaaaaaaaaaaaacaataaaactattatcgccgaattcgcacgaggggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcaaaaaaaaaaaaaaaaacaaaaaaaaaaacttttttgggaccgctccccgccccatagaaaaaaggcttttccaaacacacaccgtgtgggggcgccgcgggcccagatgggtcactgtgaaccggggccacaccgtggtccccaagagaaacctgggcgcagagaaccacagtcgcctcgggattcctcccccatataaaaaagccgccgggggggaacacgcgcgcgtctcgtggacacacgtccagg

SEQ ID NO: 432304 - DNA, 1713 bp, Homo sapiens
gaacagggcgggagattcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcaggtatgttacaaggaatgttacttctaaattttttttactctgtcctgaaaaatatgctacgtaagcaacagatttgaaaagtatacacaagtagaattattgtcctgatcaaatgaaacacaagttaatgtgattattacttcttttattatataaatagtaaataggccgggcacacctggctcatacctgtaatctcagcaccttgggaggccaagggaggaggattatgtgaacacaggagtttgagaccagcctgggcaatatagggagacctcgttgttactaaaaatttaaataaataaataaataatttactggattagacagactgtaattatgcatttttcccctcttactcgtttattatttcttcaggatctatgataatcatcagggtcatagttccttgatatccatttaccatttatctctgttattcatttaacctatatgtattcactaaatctcacactggtcataaaacagcaactgcaacctgactttctctcagttaaaaactttgcacaaagtagaggatattctgcttgaggatattatggaaaacctgcccagtgtggtaaggtaacaagattactatgtaccatggttccagtagctcattttacaaaaaa

SEQ ID NO: 432305 - DNA, 209 bp, Homo sapiens
tagaaaggtttcgaaccactatgctgcaagattccattcacgttgtcatcaatggcttctttcctggaatcagtgtgaaatcagtaagtttcaaaaatgttaaagggaaaaacattatatcctctgccaattcaagcccccacataaatgaggatggagtattaaagaatttttgttttagccttcacggtagtaggattgtatagtgc

SEQ ID NO: 432306 - DNA, 280 bp, Homo sapiens
agatttttaccagcagtgtcgggaggcattcctcgtcaatagtgatctgacactccgggcccagttaactgaatttagggaccacaagcttataagaacaaagaaggtaagactccactattgtagcattgtatgccaggaatagtccgtatcatttacttaaggacacatatatgtttgacttagacctgattttgaaactgatgttccctgttgagtcacagagattcatttaggggatgtgccatttgagtttgtagaaagagccatggtagaagta

SEQ ID NO: 432307 - DNA, 660 bp, Homo sapiens
gatatgagacagatatttgaagctactaaggactgactactctgttcactttcagagtgacttagtagaagaatattttgaagctcacagcagttcaaaagttttaacctctgatagaacactgcagaagctaaagagagctaaactggatcaggtatgttacaaggaatgttacttctaaattttttttactctgtcctgaaaaatatgctacgtaagcaacagatttgaaaagtatacacaagtagaattattgtcctgatcaaatgaaacacaagttaatgtgattattacttcttttattatataaatagtaaataggccgggcacacctggctcatacctgtaatctcagcaccttgggaggccaagggaggaggattatgtgaacacaggagtttgagaccagcctgggcaatatagggagacctcgttgttactaaaaatttaaataaataaataaataatttactggattagacagactgtaattatgcatttttcccctcttactcgtttattatttcttcaggatctatgataatcatcagggtcatagttccttgatatccatttaccatttatctctgttattcatttaacctatatgtattcactaaatctcacactggtcataaaacagcaactgcaacctgactt

SEQ ID NO: 432308 - DNA, 392 bp, Homo sapiens
ttttttatacttaaaaagactttaaaaatattagataaagacatgtattcattatgtgaatgtttaatttggtggttgatatgaattcttcatcacttttgagtaacttactgtttttgtttaggttggcaacaatgagtaaaccagaattaaaggaagacaagatgctggaggttcactttgtgggagatgatgatgttcttaatcacattctagatagagaaggaggtattaagtgattgtacaatttgaagagatgcttattataatgtttatggattatttcacttttaaaacttttaacattttcttttgaaaatatagcgcaaaggattgatctggttagtaaaactaaataaaaactgctttaatttttagtttaaaatttcaaa

SEQ ID NO: 432309 - DNA, 1696 bp, Homo sapiens
gtccggcgcctggagaaggaagacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggact

SEQ ID NO: 432310 - DNA, 2143 bp, Homo sapiens
gtccggcgcctggagaaggaagacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttg

SEQ ID NO: 432311 - DNA, 2162 bp, Homo sapiens
tgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcaccaaaaaaaaaagt

SEQ ID NO: 432312 - DNA, 1040 bp, Homo sapiens
caataaaatatttaagagtttatttgagcagtgatccagaagtggctagggagctccccagagagaacatgaggaggaggctttttaggacaaatagataaaagcaaagataatatttcattggttacagttatacagttacacagttatacagttgccttatttggtctatcccatgaggaagtcctagttactaattacgtttttgttggctgcttctgattggttgagcttaagttctgtgtttctttaacataggcatttacaagaaataccacaaataaagtttcagacatgcttgcaaatcaagcaaggttaaggtcacttaggaggcccaactggctctgtctgctcaaggattcttctggcctcgtctccattttacatgaactgttgcataaataaacacagagtacctgaaacaacggaggtgatcattctgcctaccgagtgttggccaggccaagcttggagtgttgctcttattcttagggagtttatttttaagtaatctcatctgtaaatgggattacaatccacaaactgaccttgtatatgattccattccttctcccagcccagccccacactccaaggttttccctttgcttataaggggtagtcacccttttttatttcgaccttccaaacattctgggagttttcctcctttaggccaactacagcgcagaggagcgctttctcctgctgggtttctccgactggccttccctgcagccggtcctcttcgcccttgtcctcctgtgctacctcctgaccttgacgggcaactcggcgctggtgctgctggcggtgcgcgacccgcgcctgcacacgcccatgtactacttcctctgccacctggccttggtagacgcgggcttcactactagcgtggtgccgccgctgctggccaacctgcgcggaccagcgctctggctgccgcgcagccactgcacggcccagctgtgcgcatcgctggctctgggttccgccgaatgcgtcctcctggcggtgatggctctggaccgcgcggccgc

SEQ ID NO: 432313 - DNA, 1672 bp, Homo sapiens
gcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgtttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagca

SEQ ID NO: 432314 - DNA, 1947 bp, Homo sapiens
  misc_feature (1702)..(1702): n is a, c, g, or t
gcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgtttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcaaaaaaaaaaaaaaaaaaaaaaaaaaaaaanaaaacacaaaaaccacaaccaacaacacacaaaaccacaaaaacagagaccaaaaaaaccaaagagaaagagaggcgccgaaaaaacccgagggggcaaagaacacacccgaagagaagcacaaaagacgaaaacaaccacgcgccgcaacacgagcgggaaaccaccgccacggacacacggggcaacaaacaaacagaaacgcgcgcaaagagacggaaacacacgcacacacgctaaaacag

SEQ ID NO: 432315 - DNA, 2022 bp, Homo sapiens
  misc_feature (1702)..(1702): n is a, c, g, or t
gcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgtttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcaaaaaaaaaaaaaaaaaaaaaaaaaaaaaanaaaaaagggggggggggcaaaaatttcccccggggggccccatttagggttccccgttttttgtggcacaggcgggggcccctattaggagggcggatataaaaggaagggcggggccgggtgtttaaccaccgctctgcgctgcggagacctggcctcccggggcctcctttgggagaggagccccttcccctggggggggcccttatttggggcccacttccctagagaattaagcgctaggggacacttcaccttccacggctatctcgggtacccaggggattgctggcgtgaagtcgtcctgattgttggaagta

SEQ ID NO: 432316 - DNA, 1592 bp, Homo sapiens
gcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgtttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctattgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagca

SEQ ID NO: 432317 - DNA, 14756 bp, Homo sapiens
ctgggcggccgggcgcggggagagggcgcgggagcggctcgtgcggcaggtaccatgcggacgcgcgagcccggcgaggccccggcaggcccgtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432318 - DNA, 795 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactggtgagttctttgttcaaatcgtgcatgccttttggcatttaagtttaaacgttaatgaaattacgtggggtgtgtggctctaagcgagtgcggggaagcgtgtgcgccctacgggttctcggctccaggagctgcgcatccctctggctttgtgcggatcggcgatgaaagattcgtatgcatagctttgggagttcataaaatacatatagagcactgttaaaaaga

SEQ ID NO: 432319 - DNA, 15155 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432320 - DNA, 12253 bp, Homo sapiens
agaatgtgtaacaacgacagaatgtgtaacaacgaccagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432321 - DNA, 15255 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaagctcatcaaggagggattagtcttcagtctctaaggattgagcctgacatacgctggcgtatgctacagaggtctctcctcattcctgacttccttggcaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432322 - DNA, 14661 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432323 - DNA, 5154 bp, Homo sapiens
gataaatcggctggtaccgaattcgaaagtgtgcaggcacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432324 - DNA, 4079 bp, Homo sapiens
ctagaggagtcctaacgatacagttcagaggaaggagaaagatcataacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432325 - DNA, 2755 bp, Homo sapiens
cagatgtgatgatctcctttcttaaatctttacatgtttgagaggctgaggcaggaggatcacttgaggctagaagtgaggcagcctgggcgttacagggaaaccccatctctacaaaaacttaaaaaatcagccaggcatgtggcatgcctctagttccagctactcaggaggctgaggtgggaggatccctgagcccgggagtttgaggatgcaatgagctgagattgcgccactgcactccagcctgggtggcagagcgagaccctgtctcaaaaaataaaaatattgaaaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432326 - DNA, 15499 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaaataaaaaacagaagaaaaagaacgaccaacgagctaaaaaggacgcagcacgagccacgatcgctgaaacacacgagacagagagcgaaagggggggggcgggggccgaactaagaaaatctcccacgagggggaggcaggccacaatagataggtacgaaaccaccgcggtttcgtggcaggacaaggaggctgcccaataaacataggagttgcgcattatataaacggaggaagcagcgggcggtgtaaataacaacggggtgggtgggtaagaacaagatagtggtgtagagtgctagctgagaagacgccacctcggggggggggacacattcggagca

SEQ ID NO: 432327 - DNA, 1584 bp, Homo sapiens
gctcgcagtgggcacggtatacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432328 - DNA, 1206 bp, Homo sapiens
agaggatcccgggcagaagatacctcatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtggtcagtgccattatctagcaccctgattttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaa

SEQ ID NO: 432329 - DNA, 14534 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctatccactcatccatcctcaaccacctatccgttcttt

SEQ ID NO: 432330 - DNA, 13182 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacaactcctgctacactcggatggatgaatttcacatatacatataatattttcatctacagtccaatttaataatgtgaatgcccttataaacccctaattcttcaatttcca

SEQ ID NO: 432331 - DNA, 8085 bp, Homo sapiens
ccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatgcaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaacagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctgaaataaaatcctggctggtgacaaaaaaaaaaaaaaaaaaaaaaaaaaaaaaaaaaaaaaaaaaaaaacaaaacaaaaaaaaaaaaaaaaaaaacaaaaaaaaaacacaacaaaaacaaacaaaaaaaaaaacaaaccacagacaacaaagccaggaagagaggcacaaaaaaacccgccgccggccaataaacataacaacacaacatacacccatcagccaacattcctcaccccccacccaacacccctattatcactattccctacaccacttattactacaatacacagccgctctatcccccgccaactatattcatacgtctctcaaaataacatacatatctgcctatctgtctaacacacctcactaacctctccatcaatttctgctgcgccgacccacactcctccactcaatcttacaaacccatacatatatt

SEQ ID NO: 432332 - DNA, 565 bp, Homo sapiens
taaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacagtaagagccactttttcatctcactaaagtgtcacttgagataaacagtgaggttacaaattctgtccagtcaaaatgtgtgtactcttcattagagacaagtatgctcagactgaaatccgtatgatgatttgaaacttttttggatgtcccgattgctgggttagcattgtggctttgatgttattttaattaagaaattgaatctagtcatgtttagttaatattctggagagatcatttcattttataattgataaaggttctcatctat

SEQ ID NO: 432333 - DNA, 432 bp, Homo sapiens
aattttatactgaacatttttatatttaatctttcattactttagaattcatttctctgtgatgcagtcgtcaaatttattctttccaaacagagagccagtcatgctgggcttttcattaagcaaatagacgttttcccacagaattggatagtaaaatgttatcatcttaaataaaaccctaaatcagtctcaaggggtgcaggggagtcatactttaaaaaatatgcttaaacttggttctggtttattttttcctctgtgtgattcacagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggag

SEQ ID NO: 432334 - DNA, 2444 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 432335 - DNA, 2371 bp, Homo sapiens
  misc_feature (69)..(69): n is a, c, g, or t
ggaccctgcagtggcgcctaaagtctgcgaggaggaagtcctgcgaggacttagtccctgagtccaggnatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 432336 - DNA, 2100 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432337 - DNA, 651 bp, Homo sapiens
  misc_feature (6)..(6): n is a, c, g, or t
  misc_feature (12)..(12): n is a, c, g, or t
gagtgntgctgnggtcgatctagaggatccccacgcgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtgacgactggtggaccatgacattgagaaaggtaatcactgcgcgaaatccataacca

SEQ ID NO: 432338 - DNA, 823 bp, Homo sapiens
  misc_feature (43)..(43): n is a, c, g, or t
  misc_feature (45)..(45): n is a, c, g, or t
acccacgcgtcgcggacgcgtgggtcgacccacgcgtcgggangngttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432339 - DNA, 284 bp, Homo sapiens
  misc_feature (257)..(258): n is a, c, g, or t
agagctaggagccccagcccccagtagtcacctaggatcctgtggaagtcactgtctgcacttttgccctgaggctctgggctgggtcatctcatgccagtctctgctctctccacagggtcaaggaggaggtcaagttggcctgaatggacctctccagctctggcttcctgctgagtccctcacgtttcttccccaacccctcagattttataaattttatataaatacacagagaaatagcaatataatctganncgttggggaagaacgtgaggatcgtc

SEQ ID NO: 432340 - DNA, 1776 bp, Homo sapiens
  misc_feature (1771)..(1771): n is a, c, g, or t
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtggggatcctctagagcagaccncagca

SEQ ID NO: 432341 - DNA, 2144 bp, Homo sapiens
atgtctggggtctctgcccgctggtgctgctgtctcccactcggtcatcctgagaacacagcctgagcgtctctgtcactcggggtagaccacgcggggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432342 - DNA, 2379 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctataaaaaaaaaaaaaaaaaaaaaaaaaaaaaaaaaaaaaaaaaaaaaaaaaaaaaaaaaaaaaacacacaagcactcaacactaaataagactattctcccatgataccacaccccccacacctcccctctatcataacctttactagaaccaacaactactgccctatatactgtcttcctcttatttcttacccaccctcagctgtctgctctcctacactccttccgtcaccacaacattctatacctcttttttttacaacctcctccttgtttactt

SEQ ID NO: 432343 - DNA, 1894 bp, Homo sapiens
  misc_feature (1869)..(1869): n is a, c, g, or t
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaactcccgttcttaactttganccgcggtgcgcgtgaggaaccgagc

SEQ ID NO: 432344 - DNA, 1770 bp, Homo sapiens
  misc_feature (1759)..(1759): n is a, c, g, or t
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccccgctcgtgcagcatggggatcntcatagaataa

SEQ ID NO: 432345 - DNA, 1987 bp, Homo sapiens
gctgagcggagccgcgggcgggagggcggacggaccgactgacggtagggacgggaggcgagcaagatggcgcagacgcagggcacccggaggaaagtctgttactactacgacgcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432346 - DNA, 1806 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtgacgactggtggaccatgacattgagaaaggtaatcactgcgcgaaatccataacca

SEQ ID NO: 432347 - DNA, 2481 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatgcctgcctggccttgtctcttggaagagcaccttaggccaggttcccatttccctcttcccctgggcttgcctccctagtttgcttttcctaccgatgtgctggctaggatgtgctcggtgagtgtctctggccatcatctccttgatggggtcttggtttgatctgagccacggcatgatcaggggcagatgctgctcagatcctgcctccagagtgtccctgtgtggctggagttgaccctggctgtagagtaggaagatcggacttggtcggcttggtcaggcctctggagacacccggccgctcttccaccttccttcagccagtttccacgtctctggtgcttagagatacctgagggaggcagccagcccggtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432348 - DNA, 2025 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagatcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432349 - DNA, 2153 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaaccagtttccacgtctctggtgcttagagatacctgagggaggcagccagcccggtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432350 - DNA, 1733 bp, Homo sapiens
aaaataggctagtacgaggccgggtgttgaatcggccgaggctggtctgtggcgcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432351 - DNA, 1413 bp, Homo sapiens
  misc_feature (1408)..(1408): n is a, c, g, or t
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtggggatcctctagagcagaccncagca

SEQ ID NO: 432352 - DNA, 1566 bp, Homo sapiens
aaaataggctagtacgaggccgggtgttgaatcggccgaggctggtctgtggcgattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432353 - DNA, 1811 bp, Homo sapiens
agtcattcagcaaacactgactgcccactatgtgcctagtatttaataagggctacagaagtgggagttgtggtctcggtctcagtaacgttagactctgcttgtgagaataagataaactaaaagtgcttgctcataatgtaaggcttcaagtctgtaagaccgaatgagtagagtagatgcagctaaaggtcaggaaggcttcctggaggaagtggcactagagcttgggcaacagaagagacttagggagttgagagggaggccattctaggttcagtgttactagagtgttagaagggtcttagagaactttttaaattggaaaattgaaatcccaagtgggcaagcaagggctccagcctagcactcccttttctctcccacatagcatgagggagagtggaaaggtaggagtgggtgggaaagtgttgcacccagcctttccactccaaacctcgtattgctttcttgaggttggtggtgaccaggatgtatcattttaggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432354 - DNA, 1137 bp, Homo sapiens
aaaataggctagtacgaggccgggtgttgaatcggccgaggctggtctgtggcgtgtggcctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432355 - DNA, 621 bp, Homo sapiens
  misc_feature (6)..(6): n is a, c, g, or t
  misc_feature (12)..(12): n is a, c, g, or t
  misc_feature (616)..(616): n is a, c, g, or t
gagtgntgctgnggtcgatctagaggatccccacgcgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtggggatcctctagagcagaccncagca

SEQ ID NO: 432356 - DNA, 2383 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgagtgagacccagacctagagccctatgccttccattcaataggcagctcacacttccaccaccattcctggctgcacactccctccaagctccccacctgtagagaaatctgttttcgagttccagtgcctgtaggaacaggttagggagcccgagttcctccctcttctggttccctttcccttggtgtctcttggaggacacgcagggaagcactgggcatagatgctgagctaaatcagcacccgcctgccctctcacccatgcttcccactccctcccagtctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432357 - DNA, 2046 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432358 - DNA, 614 bp, Homo sapiens
  misc_feature (609)..(609): n is a, c, g, or t
cgggtctgactctagaggatccccacgctgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtggggatcctctagagcagaccncagca

SEQ ID NO: 432359 - DNA, 2051 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432360 - DNA, 618 bp, Homo sapiens
  misc_feature (613)..(613): n is a, c, g, or t
cgcatgattcgattcgagctcgtacctcacgccgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccggcggtgcggcgtggggatcctctagagcagaccncagca

SEQ ID NO: 432361 - DNA, 1682 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432362 - DNA, 1508 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaagggtgaggaaggagctgcctgtg

SEQ ID NO: 432363 - DNA, 1426 bp, Homo sapiens
  misc_feature (1401)..(1401): n is a, c, g, or t
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgatctgctcctctgacaaacgaattgcctgtgaggaagaacaaactcctgaaatgccaagtgcctgcttagtagctttggaaaggtgcccttattgaactcccgttcttaactttganccgcggtgcgcgtgaggaaccgagc

SEQ ID NO: 432364 - DNA, 1669 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcgatgaggacgaagacgaccctgacaaggcgcatctcgagcctgagaggatgaatctatgtagggcagtgggaggagggagtgactcaggccctgccagctcctgtggggctcttcctcagttccttgagcctttcagtggctcccagaagtggcagagcccacaaaacaatgaacctctactgcctgagcacggctctcacataccaccccagcccttttcccagcactgcaccccagtttcccagggggctgcctccgcccaccaggttctggctgtagcaggctgggaaaccagtccaacctgttctcaacagggctcactgggaggaccagggatgggcttttctctctttatgtccagtgagctgtagtgttggggaaggggtctcagggtaaatgaagacctcatgggtcttcccag

SEQ ID NO: 432365 - DNA, 1469 bp, Homo sapiens
gctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcaccggggttcaaatgcaggcgattcctgaggacgccatccctgaggagagtggcggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432366 - DNA, 647 bp, Homo sapiens
tgactctagaggttaccgagaagacgacagaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432367 - DNA, 731 bp, Homo sapiens
agagctaggagccccagcccccagtagtcacctaggatcctgtggaagtcactgtctgcacttttgccctgaggctctgggctgggtcatctcatgccagtctctgctctctccacagggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432368 - DNA, 789 bp, Homo sapiens
  misc_feature (26)..(26): n is a, c, g, or t
  misc_feature (32)..(32): n is a, c, g, or t
  misc_feature (45)..(45): n is a, c, g, or t
  misc_feature (197)..(197): n is a, c, g, or t
gactgtgacccatgacatggtacttngagtgnctttacaatcatngtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtgnaatcgaacaacacactggtgaaaatgtcatgggtcaccagtcgtcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaccaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432369 - DNA, 822 bp, Homo sapiens
acgactggtgacccatgacattttaatcactgaacacatcaaagtgcacagagattttgttaagaggagagaaggctaaaaccccagtgcattgacagaagggagaggggcaagaggtgatactggaaaatgagtccagggacagatggtgaagagcatcaaacaccatgcttcagagtgcagacttaatcctaagccatgggaagcctgcaaaggttctctaatgaagacagtggtggcatgatcagaactgaattttgcaaaaataactattgcagcaatacagagaagatcgcatctgtgtaatttcaattaaaattaaaccaaacctttatggctgtgagaatggacatttcttcaaatgtcatgggtcaccagtcggcaccggggttcaaatgcaggcgattcctgaggacgccatccctgaggagagtggcgatgaggacgaagacgaccctgacaaggcgcatctcgatctgctcctctgacaaacgaattgcctgtgaggaagaacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctata

SEQ ID NO: 432370 - DNA, 282 bp, Homo sapiens
tcctaaaccagggacatgggccttctcctagcgacatatacaccactggtacagacataggagagtgatgttaaaaagatggaaatcccataggtacccgtgtctcacagtgtcttggaggcattctcctctgtttggataaataggcccagagaaacctacaaatgctttagggtgcttacgtgcaaatggttagggtgcggtggccaggtctcttgacggtcttctctcctgccccaatcagagcttccatacaatgactactttgaatactttggacca

SEQ ID NO: 432371 - DNA, 516 bp, Homo sapiens
tttactttaatggcctttttaattaggatatcggggctggcaaaggcaagtattatgctgttaactacccgctccgagacgggattgatgacgagtcctatgaggccattttcaagccggtaagtggctttatccaccccttgggctacaaacaggggattggttggcggtggaggggagcaaagcacccccaccatacctcaggaatctctccttactaaagctggtggggagatagaagtgtttgaaccctggattgctgtgtggtcagttaggggaacaaacacccatatttattggttccttctatgggtcaggtcttctgctggatacaaaaatatctaagacatgatctttgccctcacggactatggtggggaaggcaggcacatacccagtagtctatgattagtactgtttttgtatctccatttctttgggctgctgggagattattgtgttcttttggtagtggtatgtctccttggttttttgtgttcctcattgccttacatt

SEQ ID NO: 432372 - DNA, 764 bp, Homo sapiens
ctccctccaagctccccacctgtagagaaatctgttttcgagttccagtgcctgtaggaacaggttagggagcccgagttcctccctcttctggttccctttcccttggtgtctcttggaggacacgcagggaagcactgggcatagatgctgagctaaatcagcacccgcctgccctctcacccatgcttcccactccctcccagtctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaaggtgggtttgggttcagctgggacttgggtctcgaggcctgagaggatgaatctatgtagggcagtgggaggagggagtgactcaggccctgccagctcctgtggggctcttcctcagttccttgagcctttcagtggctcccagaagtggcagagcccacaaaacaatgaacctctactgcctgagcacggctctcacataccaccccagcccttttcccagcactgcaccccagtttcccagggggctgcctccgcccaccaggttctggctgtagcaggctgggaaaccagtccaacctgttctcaacagggctcactgggaggaccagggatgggcttttctctctttatgtccagtgagctgtagtgttggggaaggggtctcagggtaaatgaagacctc

SEQ ID NO: 432373 - DNA, 351 bp, Homo sapiens
ctgtccctaccttatcttagccatattttcattgcaactacatgtctccttattgtggccagatctgtttgcttactctcctgtggcataatatagaactcattatcttcttctgcctgccttcttccatgaacctcctctgaatacgctgactttcactagcctcccctttgaaactttgcactgaggcagcttcacatatttttgtatttagttgtgtcttaacaataattgtaagatttgtcacatcatctagattataaaggaaattgagagcagagatatggctgcgatcttccacagtgttgattctagcctggagcatcaggtgttcaatacatacaaactgat

SEQ ID NO: 432374 - DNA, 4666 bp, Homo sapiens
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432375 - DNA, 5918 bp, Homo sapiens
  misc_feature (4177)..(4177): n is a, c, g, or t
  misc_feature (4194)..(4194): n is a, c, g, or t
  misc_feature (4207)..(4207): n is a, c, g, or t
  misc_feature (4248)..(4248): n is a, c, g, or t
  misc_feature (4271)..(4271): n is a, c, g, or t
  misc_feature (4280)..(4280): n is a, c, g, or t
  misc_feature (4298)..(4298): n is a, c, g, or t
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaacatgggctgggtgtggtggctcacgcctgtaattccatcactctgggaagctgaggtgggtggatcacttaaggtcaggagtttgagaccagcctgggcaacatngtgaaaccccatttctnctaaaaatacaanacttagctgggcgtggttgcgggtgcctgtagtcccagctnctcaggaggctgaggcaggagantcgcttgancccgggaagcggaggctncagtgagccgagatcgcgccactgcaccccagcccagtgacagagcaagaccctgtctcaaaaaagaaaaaaggaaagggtttaacctggtgtctggcatatagtgggtattcattactattaataaggcatagctccttgcttatcagtgctacaatctagataagaagagatttactgaaaacctacatagttgtgaattattcagatgctaggtggtatcaggattcagagaagggaaagatcaaattgggctttgtggaagaagtggggattgacccaggcactgtaggttgggtagaatttgaattggtgaggaggtagaaaggcaggagattcctaacagaataacataagcaaaaggagcatgacaaagggcagaaggagggaggagagatttctgttgggaacttaaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacaccttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcatcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432376 - DNA, 712 bp, Homo sapiens
gagaagggaaagatcaaatgggcatagctccttgcttatcagtgctacaatctagataagaagagatttactgaaaacctacatagttgtgaattattcagatgctaggtggtatcaggattcagagaagggaaagatcaaattgggctttgtggaagaagtggggattgacccaggcactgtaggttgggtagaatttgaattggtgaggaggtagaaaggcaggagattcctaacagaataacataagcaaaaggagcatgacaaagggcagaaggagggaggagagatttctgttgggaacttaaggctaaaaataagaagtgaagtctgagagggcctcaaatattaggctaaggacttaaatttataagctgtaaagagttactatgtttgccaggtgcggtggctcatgcctgtaatcccagcactttgggaggccgaggtgggcggatcatttgaggtcaagagtttgagaccagcctggccaacatggtgaaaccgtctctactaaaaaaaaatacaaaaaattagccgggtgtcgtggtgcatgcctgtaatcccagctactccggaggctgaggcaggagaatcgcttgaacccaggaggcagaggttgccatgagccgagatcataccactgcactccagcctgggcaacaagagtgaaactccatctcaaaaaagaaaaataaaaaagagttactgtgtt

SEQ ID NO: 432377 - DNA, 397 bp, Homo sapiens
gctcctgaactctgggtggccagctcttgccatcttcttcctctctgatccagttgcttagaaatgcaacagaaatcaccaggcatgaacctgtttactggagcctgtttattggagcctggtgcatcatataggtatactgtggtctcatgatgtaataggaggtctccctgttccctagacccagatcagaagggcttcatgcacataggcattcatcatctatagccaagtagccctagagaaggtgcccagcaagccttgctataaagagggagggctgggtgtagtggctcaggcctgtaatcccagcactttgggaggccaaggcaggaggatcacttggggccaagagttcaggggccagcctggacaacatagcaagactctgtctcta

SEQ ID NO: 432378 - DNA, 4804 bp, Homo sapiens
ggcctcctctgtgcatagatctcgggcacggcccttcaacgggcggcgaaagctgcgactcgatgattcctcattgtagagttgggtggtccaggaggcttaactggagcccttgacctgagcggtaagggcagtcacgcgtcccgactcgggattggatcctggctctggaggataggctgcaatggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432379 - DNA, 2684 bp, Homo sapiens
gagtagctggacttgagactcacagctgaccctgatcctcagactgtgcccatttccagttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432380 - DNA, 4612 bp, Homo sapiens
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432381 - DNA, 884 bp, Homo sapiens
tgcaattaggctggtacgagccgggtgaatcggcagaggctctgcccatacatcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432382 - DNA, 731 bp, Homo sapiens
tgaggcgctctagaggacccatcactcaactggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432383 - DNA, 225 bp, Homo sapiens
ctgccatattggctgccccgggactccagaattacttcctccagtgtgtggctcctggggctgccccacacctcacacctttctctgcatgggccctgcgccatgagtaccacctgcagtacctggcactcgctctggcccagaaagcggtaggtccccctgtctgacaggttctcctgtcatcccattatctccttcctgtttctgtggaacccagcctgcttc

SEQ ID NO: 432384 - DNA, 2892 bp, Homo sapiens
gcgatctctgcggggcaagatggcggcgcccagacaggcctggagcacggatgaataagagggaacccccacacggagacactgctggagagagtcgtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432385 - DNA, 4817 bp, Homo sapiens
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcatcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432386 - DNA, 4472 bp, Homo sapiens
gcgatctctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcggttcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacaaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatggagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcaggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432387 - DNA, 1399 bp, Homo sapiens
tttttgagacggagtcttgctctgttgcccaggctggagtgcagtggcgcgctcggctcactgcaacctccgcccctgggttcaagcgactcccctgcttcagcctcccaagtagctgggactacaagcacccaccaccatgtccagctaatttttgtattttcggtagagatggggtttcaccatgttggccaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacaccttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcatcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtgctgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcc

SEQ ID NO: 432388 - DNA, 1906 bp, Homo sapiens
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaaccatga

SEQ ID NO: 432389 - DNA, 1447 bp, Homo sapiens
aaggatcccccactcttgatatatgatcagggtcctcatcctcctccatccctcaggtgatgtctggtcaccctggcctgtcctcagcaaagtctctgttaggtggctttagccagaatcccctacaccctcgatgtttcctcttagtcattttccactctgctccttggctataaacccccacctgcctgtgccatattcagagttaagctcaatctctctcccccactgcaaaacttcattacagttgtccctacaacaatcgcaatggtcctgaataaaaccttcctcgctgtgctttggcaagcataactgagtcatttttttcttgaacactccccctctctcccctgcagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaaccatga

SEQ ID NO: 432390 - DNA, 1985 bp, Homo sapiens
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaaccatga

SEQ ID NO: 432391 - DNA, 2239 bp, Homo sapiens
  misc_feature (729)..(729): n is a, c, g, or t
  misc_feature (738)..(738): n is a, c, g, or t
  misc_feature (1440)..(1440): n is a, c, g, or t
  misc_feature (1589)..(1589): n is a, c, g, or t
  misc_feature (2087)..(2087): n is a, c, g, or t
  misc_feature (2158)..(2158): n is a, c, g, or t
aacttcttttccttcccttcccctctgctagagttcttcaagttcaagggctttgggagtctctccaacctccctcggtccttcactctgagacgatcctcagcttccatcagtaggcagtcccatttggagcctgacacctttgaagccacgcaggatgacatggtgacggtgcccaagagtcccccagcctatgcccgctccagtgacatgtacagccacatgggcaccatgcctcgccccagcatcaagaaagcacagaactcacaggctgcccggcaggcccaggaggcgggtcccaagcccaacttggtacccggaggtgtacccgaccccccaggcttggaggcagccaaagaggtgatggtgaaggccactggccctctagaggacaccccagcaatggaacccaacccttcagcagtggaggtagaccccatcagaaagcctgaggtccccacaggagacgtagaagaggagagacctcccagggacgtgcactcagaaaggtaggtgcccaggggctggttgggacctgcagggatggcttctgtttttttctttttcttttttttttttttgacacagagtgtcgctctgtctctcaggctggagtgcagtggtgtgatcccggttcactgcaacctctgcctcccgggtccaagcaattctcctacctcagccccccgagtagctgggactacaggcgcccaacaccactcttggctnatttttgtntttttagtagagacaggatttcaccatgttgtccaggctggcctcgaactcctgacctcaggtgatctgcctgcctcggcctcccaaagtgctggccggggcttctttttaacccagtacacatctgggttaaaaagaaaaaaacctacacattgaccaggtgcttactgtagaccaggtactgtgctaaaccctttacttgtaattagcaaaagaaaactggcaaggagagactgttactgtttccacaggacagatgaggaagctgagattcacagagtgacatcatctgcctcagtcagggtgcatatttgctaatgacaaagccagcatgtgaaccgagaccccctgccttcaaagtcccagttagcctctagcatgggccctcagctgctggatgggtcctaaacccagtcactagacccctgccctgaaccccctcacgcaaatcatcaccattagttctgctggacaatacctccacctagtctagaaaaccatttgtcagcttaatttggttatagggtgagttgagttcatgtaaaaatacaaattgtgatgataggacaatagctcccatttagtaagcatttttactgggtatcaaaacaagtatctcactgaaaactccatagaagattcaatcattaaggctgggtgcagtggctcatgcctgtaatcccagtattttgggaggctagnagtttgaaaacagcctggctaacatggtaaaaccccgtctctactaaaaatacaaaaactagcagggcgtggtggtgcgtgcctgtagtcccagttactcaggaggtggaggcacgagaattgcttgaacttgggagatggaggttgcngtgagctgagatcacaccactgtactccagactgggcaacagagcaagactcagtcttgaaaaaaaaaaaaaagattcaattattagccccacttacagattgggaaactgagactcagccaaggttacacagaactgggatttgagcaggaatctgcttgcttccagaggctgcacacttatgtaccacattagactcaccaccttctcaatcctagggccatgcctttcacaccccgggagacccctcaatcccagccaaaggagtccccggcttttcaatccttagaacctttgtctcaaccacaccagtcacatgtgcctgttgaaataaagaaaaaaagtcagctggccgggcgcagtggctcacgcctgtaatcccaacactttgggtggccgaggtaggcagatcacaaggtcaggagttcgagaccagcctggccaaagagaccagcctgaccaacatggtgaagccctatctctactaaaaatacaaanattagccgggtgtggcggcgggcacctgtaatcccagctactgaggaggctgaggcatcagaattgcttgnacctgggaggcagaggttgcagtgacccaagatcgcgccattgcacactccagcctgggcgacaaagcgagactccaactc

SEQ ID NO: 432392 - DNA, 2753 bp, Homo sapiens
ttcgaggcggagagcgtccttccctgccggtggagtaggcggtggagtggggccgggcaaggagcgcaggggcgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactcttta

SEQ ID NO: 432393 - DNA, 3593 bp, Homo sapiens
tgggagaggcacctcaactttgatgtcccgagccttgagtggccactcgcaagctggccaagggcttcacacaatttgccaagatgacagaggggaccaagaagaccagcaaaaagttcaagttcttcaagttcaagggctttgggagtctctccaacctccctcggtccttcactctgagacgatcctcagcttccatcagtaggcagtcccatttggagcctgacacctttgaagccacgcaggatgacatggtgacggtgcccaagagtcccccagcctatgcccgctccagtgacatgtacagccacatgggcaccatgcctcgccccagcatcaagaaagcacagaactcacaggctgcccggcaggcccaggaggcgggtcccaagcccaacttggtacccggaggtgtacccgaccccccaggcttggaggcagccaaagaggtgatggtgaaggccactggccctctagaggacaccccagcaatggaacccaacccttcagcagtggaggtagaccccatcagaaagcctgaggtccccacaggagacgtagaagaggagagacctcccagggacgtgcactcagaaagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctttaaaaaaaaaaaaaaaaaaaaaacacacaaacaactaaaaaaaaaaaaaaaaaaaaaaaaagaaaaaaaaaaaaaaggggggggcgccccaaaacaccccagcagggggggccccgacgaaagaacgaaggagagcagcccgtgtatctggcagacaagaaaacagcggcccacgcaaaaaggacgacgcagctaacgacagcacgagagaggcagggggccacgagacaaacaacaccgccacatacgcgcgaagaaacacggcgaagtgagtaagcagttgatgcgaagggcaagccccacacacctgcgggcgcgagcaaaccaacaacgcgggccgagcagcccccacacacaggcaaatagacgccccacacagagcaaaaaacaagacaacggagatcctatacggcgggcacacacaaacacgaccacagcaccgcgcccagagaaaaaccgtgcccgcggggcacaatgcgagcgggaaggataacacaagg

SEQ ID NO: 432394 - DNA, 1848 bp, Homo sapiens
ttcgaggcggagagcgtccttccctgccggtggagtaggcggtggagtggggccgggcaaggagcgcaggggcgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggtgagacagcgccggcacccggggactcgcggggaacccccggctaccgcactccccgctggacggggcgggttggccaatcacagcctcagctcggctcccagggggctctggccacgcctcccatcccattgaccaatcgcaagccctgataacccgctctaaacaggctgatttcccaaagactgaat

SEQ ID NO: 432395 - DNA, 399 bp, Homo sapiens
aaggggtgcgggaatctcactttggtggggagctgctataacggggcctctctctctacctttctgcagtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatg

SEQ ID NO: 432396 - DNA, 3251 bp, Homo sapiens
ttcgaggcggagagcgtccttccctgccggtggagtaggcggtggagtggggccgggcaaggagcgcaggggcgtgtctgggggcgtggtctacaggtcagtctccgcccccggagtccggcactgagctctgcagctcagtggcccgagaaaggcaggagccgctgggtttaggaggtccccgggttgccggcggcgacagcgggggaagcatgactgctgtgggccgaaggtgccccgcgctggggtcccgaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctttaaaaaaaaaaaaaaaaaaaaaacacacaaacaactaaaaaaaaaaaaaaaaaaaaaaaaagaaaaaaaaaaaaaaggggggggcgccccaaaacaccccagcagggggggccccgacgaaagaacgaaggagagcagcccgtgtatctggcagacaagaaaacagcggcccacgcaaaaaggacgacgcagctaacgacagcacgagagaggcagggggccacgagacaaacaacaccgccacatacgcgcgaagaaacacggcgaagtgagtaagcagttgatgcgaagggcaagccccacacacctgcgggcgcgagcaaaccaacaacgcgggccgagcagcccccacacacaggcaaatagacgccccacacagagcaaaaaacaagacaacggagatcctatacggcgggcacacacaaacacgaccacagcaccgcgcccagagaaaaaccgtgcccgcggggcacaatgcgagcgggaaggataacacaagg

SEQ ID NO: 432397 - DNA, 3162 bp, Homo sapiens
ctcaggaggaaggaaggaaaaacagccgtctctggcctctggcctctccaggctctccaccctgggggcagaatcaattctgtagccctctagcaccggcagtggctccgcagtcagctgggcagtggccgtgactgggtcactctaccctaggaagtgagtgcaggggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctttaaaaaaaaaaaaaaaaaaaaaacacacaaacaactaaaaaaaaaaaaaaaaaaaaaaaaagaaaaaaaaaaaaaaggggggggcgccccaaaacaccccagcagggggggccccgacgaaagaacgaaggagagcagcccgtgtatctggcagacaagaaaacagcggcccacgcaaaaaggacgacgcagctaacgacagcacgagagaggcagggggccacgagacaaacaacaccgccacatacgcgcgaagaaacacggcgaagtgagtaagcagttgatgcgaagggcaagccccacacacctgcgggcgcgagcaaaccaacaacgcgggccgagcagcccccacacacaggcaaatagacgccccacacagagcaaaaaacaagacaacggagatcctatacggcgggcacacacaaacacgaccacagcaccgcgcccagagaaaaaccgtgcccgcggggcacaatgcgagcgggaaggataacacaagg

SEQ ID NO: 432398 - DNA, 1909 bp, Homo sapiens
  misc_feature (13)..(13): n is a, c, g, or t
  misc_feature (34)..(34): n is a, c, g, or t
tccatgtcacaangtgactgcctggttgctaggntacgggcgttaccaaggagatgcagaccctaatgggagtccgctggggcatggaactgctcaccctcccccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctttaaaaaaaaaaaaaaaaaaaaaacacacaaacaactaaaaaaaaaaaaaaaaaaaaaaaaagaaaaaaaaaaaaaaggggggggcgccccaaaacaccccagcagggggggccccgacgaaagaacgaaggagagcagcccgtgtatctggcagacaagaaaacagcggcccacgcaaaaaggacgacgcagctaacgacagcacgagagaggcagggggccacgagacaaacaacaccgccacatacgcgcgaagaaacacggcgaagtgagtaagcagttgatgcgaagggcaagccccacacacctgcgggcgcgagcaaaccaacaacgcgggccgagcagcccccacacacaggcaaatagacgccccacacagagcaaaaaacaagacaacggagatcctatacggcgggcacacacaaacacgaccacagcaccgcgcccagagaaaaaccgtgcccgcggggcacaatgcgagcgggaaggataacacaagg

SEQ ID NO: 432399 - DNA, 469 bp, Homo sapiens
aacaaaacaaaaaactactctgcgtgatgcatttccctgctgacccacagctctggccccgcccctgatttatgctgaccaatcagaagcccgaggccttgctttccacgctctggccgcgcccccttatcccattgacccttacaacctctcacgttggctccgccctccgcctctcccggcccaaccacaggcagcgccccaggcccgcacccctcacccctgtccccgagcccgccgcctctgaccccgccgctctgacaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggctcaggtactgagagccgcgcagagctggcacccggta

SEQ ID NO: 432400 - DNA, 2385 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctg

SEQ ID NO: 432401 - DNA, 2819 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432402 - DNA, 4058 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432403 - DNA, 4004 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccataatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432404 - DNA, 4211 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaaaaaaaaaaaaaaaaatgtgggcgcccggcccagaaaatttaaacatcgtgggcgggccaagaagaacaggcacgccagaaccggcgaaggtgggttccaaaaccgggccgggtgaacaagggctggttggttacggctataaccccggcgggg

SEQ ID NO: 432405 - DNA, 1957 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggttgcagtgagccgagatcgtgtcattgcactgcagcctgggcaacaagagcgaaactgtctca

SEQ ID NO: 432406 - DNA, 3901 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432407 - DNA, 3587 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggcccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432408 - DNA, 1478 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtataaaccacttctttttgttctgacagtatccccaatacaaagttaaaaaaggggccgggcacagtggctcatggctgtaatcccagcactttgggaggcctaggtgggcagatcacttgagccaggaattcaagactagcctgggcaacatggcaaaaccccatctctacaaaaaaaatacaaaaattagatgggcatgttggtgtgtgcctgtagtccaaactacttgggaggctgagatgggaggatcacctgagccagggaggttgaggctgcagtgagtcaagatcgc

SEQ ID NO: 432409 - DNA, 3174 bp, Homo sapiens
cagaagaggatggtggaagagacagcctgtggaggagtgatcaggctgggactgcagggaggttctctgtgactggtacaggaaagtacttcatggttgctgagtggttctagaggagatacatgtaaggtgagttagaaacctggcacttctatctaatgtgatagactctttcttccctgcagggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccaggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432410 - DNA, 1016 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcaaagtcatacttcccaatcacacacttgaaaatgttcagaaaaagtttctagtgcacacaagtctggtttcg

SEQ ID NO: 432411 - DNA, 1945 bp, Homo sapiens
actgcattctagcctgggagacagagtgagagcctgtctcttaaaaaattaaatttaatttaaaatgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432412 - DNA, 2059 bp, Homo sapiens
gagatggagtctcactctgtcacccaggctggcaatatcttttaaaagttaaatgggtaattctttggcccagcaaatgaacttattagtgtcagtcctagaaacagtccaatgcaacaaagaccttttgtatgagaaaattcatcatagaattgtgatagtgaaaaattggaaacaactgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaattaatgtgattttggtctctattgatatttcatagggccctgtcttattcaaccttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432413 - DNA, 619 bp, Homo sapiens
cggcacgaggcggcacgagggttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 432414 - DNA, 650 bp, Homo sapiens
aagtgcttctcttttccttggcggaggagggagaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagggatcaagtttgtggttctagcagatcctaggcaagctggaatagattctcttctccgaaagatttatgagatttactcagactttgccctcaagaatccattctattccttagaaatgcctatcaggtgtgagctccagacaagaa

SEQ ID NO: 432415 - DNA, 563 bp, Homo sapiens
ggacctcactgtcactgctactccctccgcacaaggtaagagttgtgtgcaaatatctgtgttcaagaccccgcttttggttcttttggatatatatctagaagtagaattgctggatcatataggagttgaatattttgccaacattttctattggcaaaggtgaaacaaattgaaaaatagagtgggagggagtaccaacaacaagaaatatcccagtcgctttacctctgactcctagaagggatggtggatggcaaagtgagaaagatcagaacagaggtgtttctgaacttctggtgtggacaagagctatattgttcgttaaatggggacctgccagttaagtctaatagtaaaccttagtgattttgtctgaagtatttttctgtctgctgattaaagcaaagtactagtttttcattttatgctttgatttaaaagcaaggtataacatttttttgaggccttcattaataatagaggttccaagacaccacacccttataggacatttttttccctagaatttttttttaaatgagtcttggccaggcgcggtg

SEQ ID NO: 432416 - DNA, 379 bp, Homo sapiens
gttgagggccttgaaggggaggcagtatctgccgctcctggctcctagggcagcgcctagagcacagggtaccgcactgcagcggactccgagtcgcgggagcggggatggagtgaaagggccgggataaagataatgtagagccccacatcacgtttccggagctccttacagtgcactcacaacgcataggttcagatcagagcccctaggttcagatctggaacattgacctgctgtgtggtattggccaagttaattaaactttctgttcttcagtttccttatctgtaaaatggggataacaatacctactttaaggtttgttatgaggattacattctttaatatacatcaggcctttagcacatggtaaaag

SEQ ID NO: 432417 - DNA, 766 bp, Homo sapiens
atactaaagtacaagtatgcagaaactggtaacagtgactactctggggaactgggatggattgaagaataaggggaattttaggtttatcaattttgttcgaatttctttcattgtaagcatatttgcttgtgaaattaaaaatgtgtgtattttaagtgctctgataggaggatgtggaggtttgtgtgtggttatccacgcctggccattttcaatgtgaactttgggttactgcctttcctattgccttctttcctttgtgacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgccta

SEQ ID NO: 432418 - DNA, 564 bp, Homo sapiens
acgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaaattgtcagtatttccttatagcaatgcaagccgactaacacaggtgattcttagcaaaacagtttgtcaatttttcataaatgctggaccctg

SEQ ID NO: 432419 - DNA, 3386 bp, Homo sapiens
ctgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcgtggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctgga

SEQ ID NO: 432420 - DNA, 1024 bp, Homo sapiens
ctgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggtacccatgctcttctctttcaggcgtcattcatacaacaaatattttgaggctgggccctggggatatgctggtgagcaaagtccacacgctgcccactctgaggagctcagtcaatggagggaacatttgcaaagcttctctctctcctttcagcatctccctctccactttcagtgtctccatttgtcgcaaccttttcctcagttcagctccctccagtcttagacctgggaggcgctttcttctgtaacagactgttcctatgggtcccactcttgtccaacccaggacctcattaagaattcacctgaatgagctaattctcactgggatcccaatctgaccccccttaacccagggaggagcctggtatcctacccactggtctagccttctgggctactgtggggtccttggcagaactggggtgacatatcatgctcaccacaggtctcaggattgtagcaggacacaaattaactcattttgttattttaagcccatcagttacaataaagtaagggaacagtggctttaaagacacttccagacaaatagaaattctgtctactcaaagtttctctgtgtatttggtgatttcaaaattgggaaaccttgaaagctccacaggccttggccacaaagacctaagttccagaga

SEQ ID NO: 432421 - DNA, 3698 bp, Homo sapiens
ctgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaaagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcgtggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaacttccagtagattctacttctaaactatctctggagtccatccacttctgtctgcacccacagccatcctggccaggccacatcacctcccccagatcactgccctggcctcagaaaggtcttccctcttgctttgtcaatcagttctcagtagcagcaggagaaattgaaagctgcaggtcatatcgtatcatctttagtttgaaaacctcactctcttaccctattgttctaaaggtcttcttttggtcccaacctcacttccagcctcatttcttgccagtcccagacttgctccctgagcttctgccacctgcccttccttcatttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatacttgttgaagaagtgaaaaaaaaaagt

SEQ ID NO: 432422 - DNA, 1132 bp, Homo sapiens
gtgtcatctcctgctgctgtctcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaacttccagtagattctacttctaaactatctctggagtccatccacttctgtctgcacccacagccatcctggccaggccacatcacctcccccagatcactgccctggcctcagaaaggtcttccctcttgctttgtcaatcagttctcagtagcagcaggagaaattgaaagctgcaggtcatatcgtatcatctttagtttgaaaacctcactctcttaccctattgttctaaaggtcttcttttggtcccaacctcacttccagcctcatttcttgccagtcccagacttgctccctgagcttctgccacctgcccttccttcatttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatacttgttgaagaagtgaaaaaaaaaagt

SEQ ID NO: 432423 - DNA, 249 bp, Homo sapiens
gtgagtaacttcttgtcatgattgtttagatcatagagaaacggcgtcgagaccgcatcaacagtagcctttctgaattgcgacgcttggtccccactgcctttgagaaacaggtatgtgacattgctgattgtgctagaggaaatactgtgtgggtggcagataaggttcgtttctcatggcatctcttgttgattggtagcagctgcctgagatgctgtgatcatttaccaatatctgtcactggcc

SEQ ID NO: 432424 - DNA, 4115 bp, Homo sapiens
ctgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcgtggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaacttccagtagattctacttctaaactatctctggagtccatccacttctgtctgcacccacagccatcctggccaggccacatcacctcccccagatcactgccctggcctcagaaaggtcttccctcttgctttgtcaatcagttctcagtagcagcaggagaaattgaaagctgcaggtcatatcgtatcatctttagtttgaaaacctcactctcttaccctattgttctaaaggtcttcttttggtcccaacctcacttccagcctcatttcttgccagtcccagacttgctccctgagcttctgccacctgcccttccttcatttcctcgacattccagccttgttcccacctccagcactttgcatatgctgttccctttgccaagaatgctcttcccctaccctgtgcatggctgagttctgcagaccctcaggccttggcttcaacgttgcctcgtccaagaggccttcctcgactactttacttgtggagttcctctatcacaaggcctctgttctttcccttcatggagaatttgccactgcatatccatttgtgtaatttacttgttggttgactgtgcctcccactcgagtgtaagctcatgaggccaggtgccatgcctggttcagtctccactctgtacccagcattgagcacagggcctggtccatagttggcgttcaataaatacttgttgaagaagtgaaaaaaaaaagt

SEQ ID NO: 432425 - DNA, 716 bp, Homo sapiens
ctgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacgcagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacagaccgataatgaagggccctcgtgaccggacctcatgccaaacaactcgttacaaaaagagctagggtcccagctgcgctgaagcttcatgagacctctcctcatctgtgcatggatgagtggccgactctggagcccaggctgttgcttcccagtctggtggtgaatcctccatagtctggtgagtgtaaatatgtgtatatctcttttcccttctccccttcccattgcaatttgcttattatgtcatttacttatatcaatttgcttattatattaatttccttattatatcatttgcttattatatctgcattgccatttacgtgggataaagcttgtttacccttaaaaata

SEQ ID NO: 432426 - DNA, 756 bp, Homo sapiens
tatcttagtattaaatttaatagcgttaacaaattataggttgtcagtgtgatgctggtctagtgcttagtacacaataaattcttgtcaactagctataaaaatcatatcaaatccaaatatgtctagaatttaaagaagctgtactttgaaaagtaagcagggtcctacagctttaatttaatactgctttaggcaacagagttcacacttaaaatttttaacttctaatgagagtaaccacttttaatctaattctaatcctaggaaagcccagttaagaagtgatgttctaatatccaaaccatgtatgtataggtttggtgatatatgtaagagatgttaatagcttcatagctgtgagaaagcagtactcctaagtctgaatattataacgtgaaaaaaacactggtttaattagcaaatacagttatatatttgaaattactattgggagccagacacggtggctcatgcctgtaatcccagcactttggggggccaaggcaggaggatcacttgaggcaagaagtttgagaccaccttaggcaatatagtgagacactgtctcaacaaaaaaattttaaaattagccagacctggtggtacttacctgtagtcctagctactcagaaagctgaggcaagaggatctcttaaccttttcttaagcccaggagttaaaagctgcagttaactacaattgtgctgctacactccagctggcacaacagagtgagaccctgtattaaaaaaa

SEQ ID NO: 432427 - DNA, 1019 bp, Homo sapiens
gtgagccgaaatcacgccactgcactccagcctgggcgacggagcgagaccctgtctcagaaagaaaaagaaaaaccaccgtccaggggcggagaaggaaggttctccctacttctcaggtttccactccctggccggaaaaaacctagtcctcccaggttagcacgccgctctagcccagcctcacgtctccactgcttctcagccagccaacgcctcttctgattggctctgacgtgcgtggtgcgtgaaaacgtcacgagacgccggcgttactataagagcgcagccgtggcgcttgcgcggctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432428 - DNA, 925 bp, Homo sapiens
  misc_feature (752)..(752): n is a, c, g, or t
  misc_feature (758)..(758): n is a, c, g, or t
gcctggtggcgaattcggcacgagggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaacaaaaaacctttccatcccccaatcatccatacacacttnagcttnatatgactgtgtgatgaggtgaagggtaaagaggtatggtggacctggagaaataatttcagggtggctgctcttcatcaacagtggaaggggacttatacccatgcattctttcctttcttcccttttccttttcttccttgaaacaaggggcgctcttttgccaa

SEQ ID NO: 432429 - DNA, 166 bp, Homo sapiens
gcggccacctactactactactatacggctgcgagaagacgacaggaagggccagggtggggctggggctggagacgacgaggaggaggattaagtccacctgtccctcctgggctgctggattgtctcgttttcctgccaaataaacaggatcagcgctttacaa

SEQ ID NO: 432430 - DNA, 745 bp, Homo sapiens
atcctctagagcggccgcctactactactaaattcgcggcccgtcgacgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432431 - DNA, 879 bp, Homo sapiens
gtgagccgaaatcacgccactgcactccagcctgggcgacggagcgagaccctgtctcagaaagaaaaagaaaaaccaccgtccaggggcggagaaggaaggttctccctacttctcaggtttccactccctggccggaaaaaacctagtcctcccaggttagcacgccgctctagcccagcctcacgtctccactgcttctcagccagccaacgcctcttctgattggctctgacgtgcgtggtgcgtgaaaacgtcacgagacgccggcgttactataagagcgcagccgtggcgcttgcgcggctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432432 - DNA, 793 bp, Homo sapiens
  misc_feature (12)..(12): n is a, c, g, or t
  misc_feature (14)..(14): n is a, c, g, or t
  misc_feature (39)..(39): n is a, c, g, or t
gcggcgggaaantnacggctaggtacgaggctggggttnaatcggcacgagggtggtttgcttaggtgaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaacaaaaggggggggcgcccaaaagaaccccgg

SEQ ID NO: 432433 - DNA, 731 bp, Homo sapiens
  misc_feature (24)..(24): n is a, c, g, or t
cgagcgcgccaagagagacaaaanaaagacaagaaaaaggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432434 - DNA, 877 bp, Homo sapiens
tgcagtaacctaggaattaggctaggtacgaggctggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaatagaaaaacaaaaacaaaaaaaagcaaaaaagacagcagacaaaaaaaagcagaaaacagggggggggcaaaaaaaaacccagaggggggacaaaaagggccaccacatttttgaaaacggccaccaaagggggaaaaaaaaaaaagggcggggggaac

SEQ ID NO: 432435 - DNA, 508 bp, Homo sapiens
acaaatggactgtagagaacagtccagtgggggaaggaggtgtataggtcatgctggctcatgaatgccaaggataagctaaggaactccaccttctaggcccctggacgcatggtcagcgtggggtctggctggatggggtggggcagggccccgctgcctattctacattcaagtgtccgctcactccgtgttcttgcatggtctctcgggggccttcggaggctggctggtagtggtgaggtgagaagtggcatctcctctgtatcctcccaacatctgtctgtccagaattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432436 - DNA, 751 bp, Homo sapiens
  misc_feature (24)..(24): n is a, c, g, or t
cgagcgcgccaagagagacaaaanaaagacaagaaaaaggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaacacacacaaca

SEQ ID NO: 432437 - DNA, 1153 bp, Homo sapiens
  misc_feature (12)..(12): n is a, c, g, or t
  misc_feature (14)..(14): n is a, c, g, or t
  misc_feature (39)..(39): n is a, c, g, or t
  misc_feature (764)..(764): n is a, c, g, or t
  misc_feature (774)..(775): n is a, c, g, or t
  misc_feature (779)..(779): n is a, c, g, or t
  misc_feature (781)..(781): n is a, c, g, or t
  misc_feature (788)..(790): n is a, c, g, or t
  misc_feature (798)..(798): n is a, c, g, or t
  misc_feature (801)..(801): n is a, c, g, or t
gcggcgggaaantnacggctaggtacgaggctggggttnaatcggcacgagggtggtttgcttaggtgaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaacaaaaatnaaaaaaaacnncggngngaactannncggggggnggnaaacacgggataagatgggcactggccaaaaggggctacctcgaacccagattcttgtgcaccaggggggacacatcacggggaacaccacaacgagcggggggccacaaaaaattggcgaagagacgcggggtacacgcaggagagagaagaagggcatgagacacccaaagtaacagaacagcacaatgcaaacggaggaggacccgacagaacagataaacaagaaccgacagagagaacaacaaaaaacaagcaaacagcggccaatcaaatcagcaacagacaagaagaaactgaagacgaacgaagcacacgaagagacgaacggacgagaagaggagacagacaa

SEQ ID NO: 432438 - DNA, 881 bp, Homo sapiens
  misc_feature (761)..(761): n is a, c, g, or t
  misc_feature (764)..(764): n is a, c, g, or t
  misc_feature (766)..(766): n is a, c, g, or t
cacgcgtcgccacgcgtcgcggacgcgtgggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaggaagaaacaaaaacaaaaaaacacanacnanacaaggggggcgccaaaaaaacccgaggggcccactataggcgcacccactttttcacagtgcccacaacgcccgcatcaaacacacgcgggcgaaaaagagaatggaaactccg

SEQ ID NO: 432439 - DNA, 738 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432440 - DNA, 792 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaacaaacaaaaacaaaaacacacccacacaaagccacgacaaaagaaaacaag

SEQ ID NO: 432441 - DNA, 811 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaggaagaaacaaaaacaaaaaaaacataacgaaatcggagaaataataaggaaggccaaaca

SEQ ID NO: 432442 - DNA, 911 bp, Homo sapiens
  misc_feature (766)..(766): n is a, c, g, or t
  misc_feature (773)..(773): n is a, c, g, or t
  misc_feature (775)..(775): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaacaacaacaagaaacaaaaaanaaaaaananaaaaaaaaaaaagcggggggtctttttgggggggggaaaaaggggttaaaagggggggggttattggttttcgccaacccctcttttgaaaggggaaaaggggggcccacaagagggggggatattaaacgggacg

SEQ ID NO: 432443 - DNA, 1397 bp, Homo sapiens
  misc_feature (766)..(766): n is a, c, g, or t
  misc_feature (773)..(773): n is a, c, g, or t
  misc_feature (775)..(775): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaacaacaacaagaaacaaaaaanaaaaaananaaaaaaaaaaaaaaaaaaaaaaaaaaaaaaaaaaaaaaaaaaaaaaaaaaaaaaaaaaaaaaaaaaaaaaaaaaaaaatatacaacacatggaccaaacataattttaactgaaaaaaacttttccatagggccgaaattttgagtaaattgagccaaatctgcctaaagggggttccattacaatacaatggccggctattttcaattatggaaattggaaaaacctgagtggacccaatttaaaggcgtatgaagaaataaccacttatgcatttggagaaaaaagcaatatgggcccgaacagcatgtttcttcctaaccaattgaaaaccataaaaggccaattgaaatttgaaagcctaaatattaggcaaaatatcggttaaaatgtattttaaaccaatttattttataaacacataggccgaaaatttcgaaaatccttggatatttaaaacaattctccctaaaagggtaaaaacttttcaatttgaacaatgagccctttttaaataactgggcctaaaccttaaagggcgtaaaacccttttaaaggctaaggccccctttagaggcctaaccctttaaaattttttggagtcccttcccagccttttgct

SEQ ID NO: 432444 - DNA, 758 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaacacacacaaca

SEQ ID NO: 432445 - DNA, 779 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaacaaaaggggggggcgcccaaaagaaccccgg

SEQ ID NO: 432446 - DNA, 956 bp, Homo sapiens
  misc_feature (783)..(783): n is a, c, g, or t
  misc_feature (789)..(789): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaacaaaaaacctttccatcccccaatcatccatacacacttnagcttnatatgactgtgtgatgaggtgaagggtaaagaggtatggtggacctggagaaataatttcagggtggctgctcttcatcaacagtggaaggggacttatacccatgcattctttcctttcttcccttttccttttcttccttgaaacaaggggcgctcttttgccaa

SEQ ID NO: 432447 - DNA, 1352 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaatgccaaataaacaggatcagcgctttacaaaaaaaaaaaaaaaaaaaaaaaaaaaaaaaaaaaaaaaaaatatacaacacatggaccaaacataattttaactgaaaaaaacttttccatagggccgaaattttgagtaaattgagccaaatctgcctaaagggggttccattacaatacaatggccggctattttcaattatggaaattggaaaaacctgagtggacccaatttaaaggcgtatgaagaaataaccacttatgcatttggagaaaaaagcaatatgggcccgaacagcatgtttcttcctaaccaattgaaaaccataaaaggccaattgaaatttgaaagcctaaatattaggcaaaatatcggttaaaatgtattttaaaccaatttattttataaacacataggccgaaaatttcgaaaatccttggatatttaaaacaattctccctaaaagggtaaaaacttttcaatttgaacaatgagccctttttaaataactgggcctaaaccttaaagggcgtaaaacccttttaaaggctaaggccccctttagaggcctaaccctttaaaattttttggagtcccttcccagccttttgct

SEQ ID NO: 432448 - DNA, 786 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaatgccaaataaacaggatcagcgctttacaaaaaaaaacacacacaaca

SEQ ID NO: 432449 - DNA, 897 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaatagaaaaacaaaaacaaaaaaaagcaaaaaagacagcagacaaaaaaaagcagaaaacagggggggggcaaaaaaaaacccagaggggggacaaaaagggccaccacatttttgaaaacggccaccaaagggggaaaaaaaaaaaagggcggggggaac

SEQ ID NO: 432450 - DNA, 1107 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaaaaaaaaaaaaaaaaaaaaaagggggggccgcctcaaaaatttcccccgggggggcccaagtttcggcgctccccggttttttgtgtacaaaagggggcccccttatgggggggttttaatacgcctagaggcacagcggggcccgccagtttaaaaacacgggttgcgcggacggggggacaaaacggctggaccgaacccggggggaacgctcttgtgggcaaaggaaccctctaaattcgcgggggggggggcacaacaatagtggggaccaaacatctcctctcgcgacgaatatttcagcggctccagagggggaacatatttacaccttttccaggcggttcacgggcggt

SEQ ID NO: 432451 - DNA, 878 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaaaaaaaaaaaaattgtgtgtgggggggggaaaagagccacctaaaaattaagggggttccatggatggggggagaggaaaaggggggggggggcccggggtcgagatttggacttttgggtttggttg

SEQ ID NO: 432452 - DNA, 769 bp, Homo sapiens
  misc_feature (767)..(767): n is a, c, g, or t
  misc_feature (769)..(769): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaatcactgcccgtcgtttaccgtcgngn

SEQ ID NO: 432453 - DNA, 910 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432454 - DNA, 1583 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432455 - DNA, 1673 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432456 - DNA, 652 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaacatagccccagccccaccctggcccttcgtcgatc

SEQ ID NO: 432457 - DNA, 664 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaaatccgcagccgacccggaactgctacgctatatacttaaatcctgta

SEQ ID NO: 432458 - DNA, 765 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagtccacctcaccttgtcgctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432459 - DNA, 812 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432460 - DNA, 668 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcgccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432461 - DNA, 615 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432462 - DNA, 1003 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaagtacgtactttagggggggccccggtacccaatttcgcctatagtgagtccgaatacaattcactggccgcggtttaaccggcgtacttgg

SEQ ID NO: 432463 - DNA, 941 bp, Homo sapiens
  misc_feature (939)..(939): n is a, c, g, or t
  misc_feature (941)..(941): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaatcactgcccgtcgtttaccgtcgngn

SEQ ID NO: 432464 - DNA, 617 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcgagacgacgaggaggaggattaagtccacctgtccctcctgggctgctggattgtctcgttttcctgccaaataaacaggatcagcgctttacaa

SEQ ID NO: 432465 - DNA, 780 bp, Homo sapiens
  misc_feature (422)..(422): n is a, c, g, or t
  misc_feature (431)..(431): n is a, c, g, or t
  misc_feature (434)..(434): n is a, c, g, or t
  misc_feature (469)..(470): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcccttctgttggggnccaaagggnacncccccgaagtgtttctttttcccaaaaaaaggggnncctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432466 - DNA, 557 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgagacgacgaggaggaggattaagtccacctgtccctcctgggctgctggattgtctcgttttcctgccaaataaacaggatcagcgctttacaa

SEQ ID NO: 432467 - DNA, 1037 bp, Homo sapiens
  misc_feature (980)..(980): n is a, c, g, or t
  misc_feature (982)..(982): n is a, c, g, or t
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtggtcacacangnatgcaggtagaacatcggctgcagtaatataggcctgggtaatctcgagatttaa

SEQ ID NO: 432468 - DNA, 570 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432469 - DNA, 551 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432470 - DNA, 920 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaaaaaaaaaaaaaaaaaaaaaagggggggccgcctcaaaaatttcccccgggggggcccaagtttcggcgctccccggttttttgtgtacaaaagggggcccccttatgggggggttttaatacgcctagaggcacagcggggcccgccagtttaaaaacacgggttgcgcggacggggggacaaaacggctggaccgaacccggggggaacgctcttgtgggcaaaggaaccctctaaattcgcgggggggggggcacaacaatagtggggaccaaacatctcctctcgcgacgaatatttcagcggctccagagggggaacatatttacaccttttccaggcggttcacgggcggt

SEQ ID NO: 432471 - DNA, 647 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggtgcgtatgggagtccacagcagagggatggggtgcagggcttgtgaggttcattctcccttctgttgcctctgttccagtgatgagagttgtgtcattggataaatggagccagccttctaacttttagtggcacttgtggagtaggaaaagtgtatctggaccagtctttgccctgtttcttaggtgtgtggcttttttgcccagttattggaccttcagtttagtaatgaccagagctaaagataggcctggcacacctgggcacccgtctatatctttatattctgtttatgtggcctgtttgctagtggatgagagtagactatgaagtggaatttctggg

SEQ ID NO: 432472 - DNA, 852 bp, Homo sapiens
tgcagtaacctaggaattaggctaggtacgaggctgggtggtggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggtgagtggccaaggcttccgggaagtggttcggcttccgggaggcggttagcacgtggatgaaggtgcccatgtactctatctagtccgtcccctaaatttggtactattcgtggtttaggaaggttttgtgattccaaagctgccagtctagttgttgtgccagtaggtgggactacacttgtccacccgcttctccccaccaggcgagtatgggctccggaacaaacgtgaggtctggagggtcaaatttaccctggccaagatccgcaaggccgcccgggaactgctgacgcttgatgagaaggacccacggcgtctgttcgaaggtgcgtatgggagtccacagcagagggatggggtgcagggcttgtgaggttcattctcccttctgttgcctctgttccagtgatgagagttgtgtcattggataaatggagccagccttctaacttttagtggcacttgtggagtaggaaaagtgtatctggaccagtctttgccctgtttcttaggtgtgtggcttttttgcccagttattggaccttcagtttagtaatgaccagagctaaagataggcctggcacacctgggcacccgtctatatctttatattctgtttatgtggcctgtttgctagtggatgagagtagactatgaagtggaatttctggg

SEQ ID NO: 432473 - DNA, 707 bp, Homo sapiens
gcctggtggcgaattcggcacgagggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432474 - DNA, 718 bp, Homo sapiens
tgcagtaacctaggaattaggctaggtacgaggctggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432475 - DNA, 752 bp, Homo sapiens
  misc_feature (12)..(12): n is a, c, g, or t
  misc_feature (14)..(14): n is a, c, g, or t
  misc_feature (39)..(39): n is a, c, g, or t
gcggcgggaaantnacggctaggtacgaggctggggttnaatcggcacgagggtggtttgcttaggtgaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 432476 - DNA, 586 bp, Homo sapiens
aattcggaacgaggttttagctgttcttaggtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432477 - DNA, 762 bp, Homo sapiens
caatcctcaccctcccccaactctcaaatagacccggtgtcttgtttccctcttgtgttcatgtgtactcaatgtttatgtcccaaataaatatatggaaacatggtatttgattttctgctcctgcatgaattcacttaggataatggcctccagctccatccacgttgttgcaaagaacatgatctcattcttttttatggctgtgtagtattctatggtgtatgtgtgtcacattttctttatccagtctaccattgatgggcatgtggattgattctatgtctttgctattgtgaatagtgctgcagtgaacatacccatggatgtgtctttatgtgatttaacccattttataaatgaaaaactgatgtccagacaggccagacaatttctatacacccaggtggaaacaaagccaggattagagttccatgtcccaactccattgtgcatgtgttgcctctcatttttcttggatccctgtatattctcctaatttgataactaattgtttcatgtgagtttttcattttcaaaatactaaaatttttactttctgctgattgttgctagagttaatgattatgatttcaatatccctattttccttttttttttttttctctaaccccaactttagggaacagaagtcaaagcaataacatattcagcaatgcaggtctataatgaagagaacccggaagtttttgtgatcattgacatttaagacaccaaaaaataaaagactcctacgaagaa

SEQ ID NO: 432478 - DNA, 1030 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccatggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggagacagggtgttgctatgttgtcgaggctggtcttgaactcctggcttccggcgatcctcctgcctcaattttgcaaagtgctgggattacaggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432479 - DNA, 952 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432480 - DNA, 996 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432481 - DNA, 515 bp, Homo sapiens
ccgggaattcccggtgtcgactactactactaaattcgcggccgcgtcgaggtgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432482 - DNA, 1093 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtgagtatagcgggagttcattcctttgaaaccacgtcagtaggaagactgaatgtttcaatcttggtatccctatctttaatttttctcctctcattttggttccttcacaatatgaaaatgatggtttgaaagcactcagttttgcagggttcagtggctcagtgagccgagattgcaccactgcaccccagcctgggtgacagagagaccccatctcaaaaaataaaaaataaaaataaggccgggtgtggtggctcaacgcctgtggtcccagcactttgggaggctgaggcggacggatcatgaggtcaggagttcgagaccagcctgaccggcatggtggaaccccgtctctactaaaaatacaaaaattagccgggtctggtggtgcctgcctgtagtctcagctcccgagtagctgagattatacgcgcctgctaccacgcctggctaatttttggtattattagtatagacggggttacactgtgttggccaggctggtctgaagctcctgacctcaggatgatctgcccgcatcagccctcccaa

SEQ ID NO: 432483 - DNA, 669 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432484 - DNA, 853 bp, Homo sapiens
caatcctcaccctcccccaactctcaaatagacccggtgtcttgtttccctcttgtgttcatgtgtactcaatgtttatgtcccaaataaatatatggaaacatggtatttgattttctgctcctgcatgaattcacttaggataatggcctccagctccatccacgttgttgcaaagaacatgatctcattcttttttatggctgtgtagtattctatggtgtatgtgtgtcacattttctttatccagtctaccattgatgggcatgtggattgattctatgtctttgctattgtgaatagtgctgcagtgaacatacccatggatgtgtctttatgtgatttaacccattttataaatgaaaaactgatgtccagacaggccagacaatttctatacacccaggtggaaacaaagccaggattagagttccatgtcccaactccattgtgcatgtgttgcctctcatttttcttggatccctgtatattctcctaatttgataactaattgtttcatgtgagtttttcattttcaaaatactaaaatttttactttctgctgattgttgctagagttaatgattatgatttcaatatccctattttccttttttttttttttctctaaccccaactttagggaacagaagtcaaagcaataacatattcagcaatgcaggtctataatgaagagaacccggaagtttttgtgatcattgacatttaagacaccaaaaaataaaagactcctacgaagaaaaactaagcacgaccacacaaaacgaacaaattaaggagcaccacacaataagccactcctatattcgccacagtgaagacatataacaca

SEQ ID NO: 432485 - DNA, 1238 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcattcgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaat

SEQ ID NO: 432486 - DNA, 694 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432487 - DNA, 209 bp, Homo sapiens
  misc_feature (61)..(63): n is a, c, g, or t
gtgttatgtttctttaaatttttcatcctattatactatatatcgtcgttctaggtggggnnnagattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432488 - DNA, 388 bp, Homo sapiens
ctgtactccagcctgggcgatggagtaaggctccatctcaaaaaaaaaaaaaaaaaaaaaaaaaaaggttttaccaatttttagtagatggtccaaaaaaacaaaacagaacaaaaagatttttagtagatagtctattatgaactttttttaattaaaaaatttttcttcctgtctaggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432489 - DNA, 2001 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432490 - DNA, 1932 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432491 - DNA, 1945 bp, Homo sapiens
  misc_feature (792)..(794): n is a, c, g, or t
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggggggnnnagattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432492 - DNA, 1699 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432493 - DNA, 1970 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtgagtatagcgggagttcattcctttgaaaccacgtcagtaggaagactgaatgtttcaatcttggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432494 - DNA, 1801 bp, Homo sapiens
tacgcgtgaatcctttatgagatttataagaacatcaacaaacagtaactgggcaagaattccaaagacatttctttagtcctctttcaataagcacattttctgacattaggtagtaataaaagacagtgctcatatcgaggcttactacatgcttttggaattgcaggattttgttatttaaatttagactgtgattctctgagtaactgtatatattgctttaccccaaatccactcaaatcctctgagcagcagtccttcgggtctaaatgcaatctgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432495 - DNA, 1888 bp, Homo sapiens
  misc_feature (735)..(737): n is a, c, g, or t
attttcattgtataaaaattttaggaactagttgtgaaagctttaaaaggaaatttaagaactccaaaggccattatctttaggcatttaattgaagcctggcagctattttcccaaatgccatcaggaaagttttctttctcttacacatacacatgtgcaaattacactcccagattaaaaatcactactggcatgatagggaaatgacctcattcattctctctgtccccgcaaaaaaaaaaagattccaacaaagcaaagcaattagctttgttgagtgaatagatagcaaaaggtgtggatggactggcccacattttcttgctctttaaagatgatattcctaataataatggactagagttattttgtgtgtgtgatttgagagtcaagtttagtgtcttataagtgtttttccctctgtccctcagatttggatcatacagcagatgtccagtgagtatagcgggagttcattcctttgaaaccacgtcagtaggaagactgaatgtttcaatcttggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggggggnnnagattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432496 - DNA, 2035 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccatggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggagacagggtgttgctatgttgtcgaggctggtcttgaactcctggcttccggcgatcctcctgcctcaattttgcaaagtgctgggattacaggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432497 - DNA, 1356 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaagaaaaaaacaaaaaaaaaaaaaaaaaaaaaaaagaggagggggggaggccgatcatgaaaaagagggcgccaaagaggaaagaagaccaagaggcgaagaaagagagagaagaagagaagggggcaggcagcaaggagagcggagggcagagaaaacgacgagacaagcgtggaggaagaaaaaccagcaacgagaggaagacccggacagaaacagaaaaagacgtcgatgatgagagcaacaaaaaaacagaacgaagccaaaacaggagcagacgaacacacagaaaaaggagagcagaaaac

SEQ ID NO: 432498 - DNA, 1767 bp, Homo sapiens
caatcctcaccctcccccaactctcaaatagacccggtgtcttgtttccctcttgtgttcatgtgtactcaatgtttatgtcccaaataaatatatggaaacatggtatttgattttctgctcctgcatgaattcacttaggataatggcctccagctccatccacgttgttgcaaagaacatgatctcattcttttttatggctgtgtagtattctatggtgtatgtgtgtcacattttctttatccagtctaccattgatgggcatgtggattgattctatgtctttgctattgtgaatagtgctgcagtgaacatacccatggatgtgtctttatgtgatttaacccattttataaatgaaaaactgatgtccagacaggccagacaatttctatacacccaggtggaaacaaagccaggattagagttccatgtcccaactccattgtgcatgtgttgcctctcatttttcttggatccctgtatattctcctaatttgataactaattgtttcatgtgagtttttcattttcaaaatactaaaatttttactttctgctgattgttgctagagttaatgattatgatttcaatatccctattttccttttttttttttttctctaaccccaactttagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432499 - DNA, 1737 bp, Homo sapiens
agaaaagcacctggttgcagtgctgttaaattgattgaggccttaaaatttgtatttatcatactgaatttattttgactttgcctgctatcaaattttctttcttgcagtggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggtaaatgatttattcacaaggaagaaattgttatacagtactgtatagaattgtgcagtattctacataatctgagtatattttcacaaaaagaaccagaaaattaaggatgagtcttttctttctctttaaactgacctaagacatttatttattgcacttttaaattcaagtatgtttttagagaccagaattattaaatatactatttgatcttgtgtaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttctttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgccaccatgcccggctaatttttgtatctttagtagagacggggtttcactgtgttagctaggatggtcttgatctcctgaccttgtgatccgcccaccttggcctcccaaggtactgcgattacaggcatgagctaccatgcccggccacaagacatagattttctatatgcacatcaagggaggtgctggtttaggttgctataggacagagctatcctgtattccagttggtttttgtagagaaacaattagacttctctagatagagccctgatttttctctcacgctttcagttttttaaaagcactaatgatatttcctgttttctcataagaaaaagtcaatactatgccttacaaagagacctttccttctaatatagaattttatttgaaagtgagtacatgtttataactagagaataaaaggagaatttttg

SEQ ID NO: 432500 - DNA, 965 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtgagtatagcgggagttcattcctttgaaaccacgtcagtaggaagactgaatgtttcaatcttggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432501 - DNA, 899 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432502 - DNA, 874 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432503 - DNA, 805 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432504 - DNA, 1299 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtgagtatagcgggagttcattcctttgaaaccacgtcagtaggaagactgaatgtttcaatcttggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccgggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaaaaaaaaaaaaaaaaaaaaaaaaaaaaaaaaaaaagaaaaaaacaaaaaaaaaaaaaaaaaagggggggggcacaaaagatatcccaagaaggggcccacagagaaagcggaacaccaaaatgtcaggacaaagagggggacccaaaatgggggaggagcgtatatagaaaggagaagagaagcgggaaagagagtagagaaagaagagagagatggagaaaaacacgggagacagagagagacacacaagagagacaacacacacacacacggagggggcg

SEQ ID NO: 432505 - DNA, 1134 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggaagttgtgtgctattgttttctagaaaaggttgtaaaggccaggcgcggtggcttacgcctgtaatcccagcactttgggaagccgaggcaggtggatcacctgaggtcaggagttcgagaccagtctgaccaataaggaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432506 - DNA, 940 bp, Homo sapiens
  misc_feature (792)..(794): n is a, c, g, or t
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggggggnnnagattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432507 - DNA, 1036 bp, Homo sapiens
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtaggtggcttacttctctctttacattggattgtattacacagagcatgaatatacttctttaggttacacgcatggggagatactctggaggaagcatttgagcaatgtgcaatggccatgtttggttacatgacagatactgggacagtggagcccctccaaacagtagaagtagaaacccaaggagatgacttacagtctcttctgtttcactttttggatgaatggctttataagttcagtgctgatgaattcttcataccccggagacagggtgttgctatgttgtcgaggctggtcttgaactcctggcttccggcgatcctcctgcctcaattttgcaaagtgctgggattacaggtggggagaagaattttcattgtccaagcaccctcagggaacagaagtcaaagcaataacatattcagcaatgcaggtctataatgaagagaacccggaagtttttgtgatcattgacatttaagacaccaaaaaataaaagactcctacgaagaa

SEQ ID NO: 432508 - DNA, 1014 bp, Homo sapiens
attttcattgtataaaaattttaggaactagttgtgaaagctttaaaaggaaatttaagaactccaaaggccattatctttaggcatttaattgaagcctggcagctattttcccaaatgccatcaggaaagttttctttctcttacacatacacatgtgcaaattacactcccagattaaaaatcactactggcatgatagggaaatgacctcattcattctctctgtccccgcaaaaaaaaaaagattccaacaaagcaaagcaattagctttgttgagtgaatagatagcaaaaggtgtggatggactggcccacattttcttgctctttaaagatgatattcctaataataatggactagagttattttgtgtgtgtgatttgagagtcaagtttagtgtcttataagtgtttttccctctgtccctcagatttggatcatacagcagatgtccagtgagtatagcgggagttcattcctttgaaaccacgtcagtaggaagactgaatgtttcaatcttggtatccctatctttaatttttctcctctcattttggttccttcacaatatgaaaatgatggtttgaaagcactcagttttgcagggttcagtggctcagtgagccgagattgcaccactgcaccccagcctgggtgacagagagaccccatctcaaaaaataaaaaataaaaataaggccgggtgtggtggctcaacgcctgtggtcccagcactttgggaggctgaggcggacggatcatgaggtcaggagttcgagaccagcctgaccggcatggtggaaccccgtctctactaaaaatacaaaaattagccgggtctggtggtgcctgcctgtagtctcagctcccgagtagctgagattatacgcgcctgctaccacgcctggctaatttttggtattattagtatagacggggttacactgtgttggccaggctggtctgaagctcctgacctcaggatgatctgcccgcatcagccctcccaa

SEQ ID NO: 432509 - DNA, 705 bp, Homo sapiens
  misc_feature (632)..(632): n is a, c, g, or t
gcagcaagagggcagccattttcttgaaggctattaagcttacgaccctttcagagtactgagatgaaaaatctagaatgccttcgggtctagttatcaattttgggggtgaagcgggggaaagaacctcgccagtcagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtagccaagatcttgctgtatcgtccaggctgaagtgcagtggcaccatcatagctcactgcatcctttactcagtgatcctaaggctcaagtgatcctcccacccgagcctcctgagtanctgagactacaggcatgtgccaccacgcccacctaatttttaaagttttttgtagagactgcgactttttatg

SEQ ID NO: 432510 - DNA, 493 bp, Homo sapiens
gtgttgctatgttgtcgaggctggtcttgaactcctggcttccggcgatcctcctgcctcaattttgcaaagtgctgggattacaggtgtgagcattgcacgcagcctcatccacactttttatgtttcccaagtttgagctatatttatgtccatccattttttccttttgttccatgaaatttagtagccctgtcacattggcctaagttaaacaactgcagcttttagttttccttaacatgaaaaaaggaaaagccaaatggagattgcttgctgctgtcatcctttagaagggaacacatctgcaatgtcattgttatttaatagagatggcactctctgcttttataattcctccattctctgctttaccagcttcactacttatactcattctatcaactgagtcactcatcctacagaattcaagtgcctaccagtagtttattaggctcagagtgattgaaatcctatgtcgtcctcctccacc

SEQ ID NO: 432511 - DNA, 712 bp, Homo sapiens
atggcactctagcctgtgggcaaaagagcgaaactccgtctcaaaaaaaaaaaaaaaaacaaaaaaccggtgggcctgctatctccctccgtcctggaggaagggggcatcaggggcagaccagaggacagagttgacttacggagaggaaatgcctgatcgggagggtcaggatgggttcctgccatcacaggtccagaggcagctcaagtcttttccttgccctggcccttgaaacacaggcgggttgctgggagggaggagatggagcagatgcatcgctgccatcacttctggctgagaactcttcacaaccccttgaacagcaagtcggtagcaccgtgctgagaagtctgggcatgccagggttgagcagaagcctgtgtggggtcacggtcgcaggttatgacaaggcagtgaacaccccacagctcacaaagcagaagtgcagttacataggccagtgagggtcccgtgacaggggtcaagaaagggattccgaggccaataagccctcctttctcttggcattttgggaatgccatctctgctgctccgtggtcccgcagagagctcggggctatgctgagccgaggcctcccagggtgcctgctgtgccttcactgtttcagtcagggacttgccagctatggaatgccattaaggtcacctttcccgggcctccaagaaccttgcaattatgaaaaaaaaa

SEQ ID NO: 432512 - DNA, 6980 bp, Homo sapiens
  misc_feature (3)..(5): n is a, c, g, or t
  misc_feature (9)..(9): n is a, c, g, or t
  misc_feature (2794)..(2794): n is a, c, g, or t
aannnctgntccccccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcacncatgcacctgcctgggtcacagggaatgccacaaccccaccaatgcctgaacaggggattgcagagatacaggaagaacaagtgaccccctccaccgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagtacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctg

SEQ ID NO: 432513 - DNA, 8577 bp, Homo sapiens
  misc_feature (3)..(5): n is a, c, g, or t
  misc_feature (9)..(9): n is a, c, g, or t
  misc_feature (2794)..(2794): n is a, c, g, or t
aannnctgntccccccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcacncatgcacctgcctgggtcacagggaatgccacaaccccaccaatgcctgaacaggggattgcagagatacaggaagaacaagtgaccccctccaccgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagtacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggtaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgctta

SEQ ID NO: 432514 - DNA, 8144 bp, Homo sapiens
  misc_feature (3)..(5): n is a, c, g, or t
  misc_feature (9)..(9): n is a, c, g, or t
  misc_feature (2794)..(2794): n is a, c, g, or t
aannnctgntccccccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcacncatgcacctgcctgggtcacagggaatgccacaaccccaccaatgcctgaacaggggattgcagagatacaggaagaacaagtgaccccctccaccgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagtacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggtaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccacctagacgtcgctttccacctagacgtcgctttccacctag

SEQ ID NO: 432515 - DNA, 3407 bp, Homo sapiens
cacttcccaaaaacacgatgtgaaggtttaaacaaaacacctcaccccttccccacgcccaaacccaaaaactatgtagcaacacactcctcgaccacccaaaccccagcaggagccgggcattgtggaagcagcgagtctcagcctccctggagccctcatttgaagcccagagcacctctccccatctaaaatgacacatactttttttttcaagagtactgccttttgttctagcatctttccacaagaattttatgatcctctctgcccccacccccacagttccacaggggcaccctttgtccagaagggcgagggtcccagcattagggagagtctggacacagccctcagcctcctcctctctccgatttcctcctcccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagtacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggtaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgctta

SEQ ID NO: 432516 - DNA, 1956 bp, Homo sapiens
tcgtggaaccggtgtctatcgatgcgtccaagtagtcactacaggcaccgaacacgccggtaatttatgtatttttagtagagacggggtttcaccgtgttagccaggatggtttcgatctcctgacctcgtgatccgcccgcctcggcctcccaaactgcggggattacaggcgtgagccattgcgctcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggtaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgctta

SEQ ID NO: 432517 - DNA, 1717 bp, Homo sapiens
cagagactcactcccagctagtttgggttggagtgagtctctgcttgtaaactcagaggaatgcctgcccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggtaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaagattgctta

SEQ ID NO: 432518 - DNA, 1921 bp, Homo sapiens
  misc_feature (3)..(5): n is a, c, g, or t
  misc_feature (9)..(9): n is a, c, g, or t
aannnctgntccccccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctggggtaaggataccctgtcttgggtcctagaagagcagggcctctagaactctcttctcccaccttggcttccccctctgctctcacagaggggctgagttgtcaccttgtccctcattctttcagccaatcaacaaacgcttgttgagcacctgctttgtgccggggtccaggggtcctaaaccggtggacctggacttcaccccgttgcaacctttagacctagactgctctatttctgcccaatctatcatcccctcctgcctttgcttccctcatatcccgctgtgaacctcaactccctggtcccactcgttccacctcatccctcctacaaaccccaactctcctggatcaacccaaccagttgttacctcagcacctacagctgcgcctctgcttcccacagaatctctgtggattcacgccatggcacactctttgttattgcctgacaacccctccctgtgtgcctggacattttctccctccatttctcagagcagctactccag

SEQ ID NO: 432519 - DNA, 473 bp, Homo sapiens
gacttcagcctctggctgtcacacttagggtttcactctagggcagtggccagggcttactaaccagagaggtggaggcagccagcagaggcacctgggctccctacagcactctcctttgtttcctcttagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggct

SEQ ID NO: 432520 - DNA, 364 bp, Homo sapiens
tgccccgccaactccaccgggaagttctgccacctgcctatcccgcagccggacagggagcctccagggagggggtcccgccccagggccttgctggaagccccactgaagcagtccactttcacactgccgctctccaaccagctgggtgagtgccggcacagctgggccggcgggaccctgggaggagtgccagttgggtggaggctgtcaccatggctgtgacagggatagggaagctgcctgtagtccttcctttatgatcaaacctccctctttctcctggccctcagcgctaagtttcattccctcaacttctcagccccctcccatcggaatttatcgacttgtttttgccctttcc

SEQ ID NO: 432521 - DNA, 442 bp, Homo sapiens
atgggctactcagggcccagaggaagctacacaggaccctaacagggaagggacccgtggctgggtctgctgacagccatctctactctagatgtggacgagtgtgccaccacagacccgtgtgtgggagggcactgtgtcaacaccgagggctccttcaactgtctatgtgagactggcttccagccctccccagagagtggagagtgtgtgggtaagggctctggggggagggcacagggctctgcccacatctgcccatctctacactgcctggtccttagctcccatggagcagagcactttccacagatgaagtgtccaacaaatagtgtatgtattgagactcagggctcaggggctgtccaaggatgacaaaatgaagacaatcatcatcttcgtgctggcagagcacacaatctagttttaaaggccaaattga

SEQ ID NO: 432522 - DNA, 426 bp, Homo sapiens
aatacgtggagttgatgagaaaggggagccaaggctttatacgtctaaagaaaatattcagtagctgaatccgcccagtgatagcctgtgggcaccagcagcaagggctgccatgggatacagtacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctg

SEQ ID NO: 432523 - DNA, 3700 bp, Homo sapiens
cattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432524 - DNA, 1067 bp, Homo sapiens
accgttaatgtgtgtcttctcttccccagtgctggccattcaggcccgaaagcggaggccgaaaagagagaaacatccgaaaaaaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtgagacttttgacggcagcccctaggccctagtacctaattggttaggctttcaacatgaatgctgtttacaaatatgtatatgtattacatatgtatcagtgcataatgtatatatgttatgtatgttacatatgtatcagtgcataacattttgaactcttattaagtcagtatttaatgatattttgtgttgtgaagggaacaacatgtaattgtcaggcatacgttttttgcctgtcgttttttttttttaaggtatgtgacatggtacaattacattgtttttgttcagtatctactataaaacatccacttagttcattaggaagtaatttagaagaaataacttactgggtttatttacta

SEQ ID NO: 432525 - DNA, 970 bp, Homo sapiens
atagcctcccaaagtgctgggattacaggtgtgagccacggcaccaggcctcatcccattacattctaaagattgtgtcaaaatgagttatgcttcttgtgaggtgatgggaccgttatatctctccagtgtctgtggtacaacagactaaaagatgaatatatttaatttcttaatgtttcttttgctaattttccttagctagcaatatatgtgttagctttagtgtctttttaggttcagattatttttggtagaccttaaaaaatgagaagataaaggatatccgaaagaagccttaaggtagatcctttacttggaagtatcaggctcttccacctgactccactcataataaaaaatgaaaacaaaagtggttgacgtagcaaagattttaacttttaaagcttgatagagctttgcaggtttaggaagataacttcccagtcttcagattgggatggtgagactgtgtggccccacctccatgcaggccatgcagaacacaggactgtagagaaacagaggctcattctcagttccaacaggaggaagagtgcccactgggcagccagtcctgttagggcaaggagcagcccttctggagacatggcagatcttaacgtttcagtgcatatggatgggggagggtgttctggggctggtggaacgtagagggcattcatggtggtgaaagtgggatgtaggagagggtttgggtgatgatggataactgggttcactgtgtgctaactgagctgaacagagtatgaggcgttggcctacattgtctccctggaaagactgctgtcacaggttctcttgctggcattgtgatgcagggctgcgtgaagccctccttacagcgggaggtgggctctgttggagtgggccctgtgcctctgctgtctcctactgctaacgtgaggcatcagctgaggagggatggggatgaactattttaggcagg

SEQ ID NO: 432526 - DNA, 392 bp, Homo sapiens
  misc_feature (7)..(7): n is a, c, g, or t
gccattngttggaccatggcaaatttaaaaccaaaggttttcttgcagctggtacccatcccatgtctcacagcccctggccactgacagatcagcagatgtcacccacatgggcttctgagaaagctcttaatttctttatgaaatttgcatgctaagtttttctaatgaggctgtaggtttccatgtaaattctgtgatagatagtggctgtagactggtgatgctatccgtgatttctatgagaaacatccttacaagaaccatagggcataatttatatcttccctaagtgtaaaaggatttttatcagggtgatagtatacttgaatgaaatttgtctaatgcagtttttgcttatgttggaaaataaactagattatgaattttta

SEQ ID NO: 432527 - DNA, 3688 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432528 - DNA, 4621 bp, Homo sapiens
  misc_feature (4364)..(4364): n is a, c, g, or t
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttccacagacattgccttggtcattgccctataaatgatagaatcaatgaacatttgctatcagagtagtgtcactaaaactaaataccagcattcctgttgcagcagatgtagttgtagaacatgcattgaggcgtattataaggaaatcatttattgttttttaagggcagaagggatttaggagaaaagctacagtatagattgattctctagaatatcaatgatcccttttcatccatggttcatcaaaaacatactaactgcatttgtttgatcattgcaaatttaaaacaaaacagcatttgctgttaggaaacaagacacataatcctcttaggaattaccattatatcacattaccactgtgaggtagaatggatcattcattaatttctttatgaaatttgcatgctaagtttttctaatgaggctgtaggtttccatgtaaattctgtgatagatagtggctgtagactggtgatgctatccgtgatttctatgagaaacatccttacaagaaccatagggcataatttatatcttccctaagtgtaaaaggatttttatcagggtgatagtatacttgaatgaaatttgtctaatgcagtttttgcttatgttggaaaataaactagattatgaatttttaaaaaaaaaaaaacaaaaaaaaaacaaacnttggtgggccggctcaggccttgagagaaaagttttcaaacaccatttcttgtgggcgcgcgggggcccatgtggtttacttgaccttggccaaaggtggtccaaaggaaaatcgtgcgcctggacatgcgtgtggtttcctcccaaataaaaaacgcgcggggacaccgaggtgcttggacaattccagatgggtccgcgccatacgggtccaccaccggtccaggagccgtactacggacgcgggagggggggcg

SEQ ID NO: 432529 - DNA, 4335 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttccacagacattgccttggtcattgccctataaatgatagaatcaatgaacatttgctatcagagtagtgtcactaaaactaaataccagcattcctgttgcagcagatgtagttgtagaacatgcattgaggcgtattataaggaaatcatttattgttttttaagggcagaagggatttaggagaaaagctacagtatagattgattctctagaatatcaatgatcccttttcatccatggttcatcaaaaacatactaactgcatttgtttgatcattgcaaatttaaaacaaaacagcatttgctgttaggaaacaagacacataatcctcttaggaattaccattatatcacattaccactgtgaggtagaatggatcattcattaatttctttatgaaatttgcatgctaagtttttctaatgaggctgtaggtttccatgtaaattctgtgatagatagtggctgtagactggtgatgctatccgtgatttctatgagaaacatccttacaagaaccatagggcataatttatatcttccctaagtgtaaaaggatttttatcagggtgatagtatacttgaatgaaatttgtctaatgcagtttttgcttatgttggaaaataaactagattatgaattttta

SEQ ID NO: 432530 - DNA, 3950 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaagccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttccaaaaaaaaaaaaacaaaaaaaaaacagacagagaaaaaacaaaaaaaaacctccccagaggcgcgggagatccggcgacgcaaaaggggcgcgagagcaactaccagagaggggggacgccggagaccaacgttttgtggtgcccctctaaagggaggggggaaatataacagagctgggggaaaaaccagggggcacaaagtggtacctgggtggaaactgggatccccggcacaaattccccccaaatttccgaaacacgc

SEQ ID NO: 432531 - DNA, 3752 bp, Homo sapiens
ggcggcggcgcaggcgcggttctcgtctcctcccggccggcggagcgagtggaggctgcagcccagctcgtctcggcgcccgcgtcgccgtcgcgaagccccccgccccgcttccgccgcgtcggaatgagctcccggaaagtgctggccattcaggcccgaaagcggaggccgaaaagagagaaacatccgaaaaaaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432532 - DNA, 3706 bp, Homo sapiens
cttggatcagcggactctgggggaagccagccactcaagcagtcctatgaaggggtccgtgcagtgaggaaatgaggcctctgcaacagctatgcaagtgaattatcttggtaacaggtctttcagcctccgtcaagccttcagatgactgcggcctcaagtgacatcttgactcaccagctaaactgctcccaaattgctggaccacaaaaactgccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca

SEQ ID NO: 432533 - DNA, 4590 bp, Homo sapiens
atagcctcccaaagtgctgggattacaggtgtgagccacggcaccaggcctcatcccattacattctaaagattgtgtcaaaatgagttatgcttcttgtgaggtgatgggaccgttatatctctccagtgtctgtggtacaacagactaaaagatgaatatatttaatttcttaatgtttcttttgctaattttccttagctagcaatatatgtgttagctttagtgtctttttaggttcagattatttttggtagaccttaaaaaatgagaagataaaggatatccgaaagaagccttaaggtagatcctttacttggaagtatcaggctcttccacctgactccactcataataaaaaatgaaaacaaaagtggttgacgtagcaaagattttaacttttaaagcttgatagagctttgcaggtttaggaagataacttcccagtcttcagattgggatggtgagactgtgtggccccacctccatgcaggccatgcagaacacaggactgtagagaaacagaggctcattctcagttccaacaggaggaagagtgcccactgggcagccagtcctgttagggcaaggagcagcccttctggagacatggcagatcttaacgtttcagtgcatatggatgggggagggtgttctggggctggtggaacgtagagggcattcatggtggtgaaagtgggatgtaggagagggtttgggtgatgatggataactgggttcactgtgtgctaactgagctgaacagagtatgaggcgttggcctacattgtctccctggaaagactgctgtcacaggttctcttgctggcattgtgatgcagggctgcgtgaagccctccttacagcgggaggtgggctctgttggagtgggccctgtgcctctgctgtctcctactgctaacagtgaacaaccaaggcgatgggctgtaggatgttgatacatctgaggggccagatggccaccatatcagggaaagccaatgtgttttgaaaaatatgcaaatgttcaataagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcca
